(12) United States Patent
Buck

(10) Patent No.: US 11,525,148 B2
(45) Date of Patent: Dec. 13, 2022

(54) BIDIRECTIONAL MULTI-ENZYMATIC SCAFFOLDS FOR BIOSYNTHESIZING CANNABINOIDS

(71) Applicant: Khona Scientific Holdings, Inc., Lone Tree, CO (US)

(72) Inventor: Jordan Buck, Boulder, CO (US)

(73) Assignee: Khona Scientific Holdings, Inc., Lone Tree, CO (US)

( * ) Notice: Subject to any disclaimer, the term of this patent is extended or adjusted under 35 U.S.C. 154(b) by 0 days.

(21) Appl. No.: 16/694,417

(22) Filed: Nov. 25, 2019

(65) Prior Publication Data
US 2020/0165641 A1  May 28, 2020

Related U.S. Application Data

(60) Provisional application No. 62/836,265, filed on Apr. 19, 2019, provisional application No. 62/771,839, filed on Nov. 27, 2018.

(51) Int. Cl.
| | | |
|---|---|---|
| *C12N 15/70* | (2006.01) | |
| *C12P 7/42* | (2006.01) | |
| *C12N 15/82* | (2006.01) | |
| *C12N 15/74* | (2006.01) | |
| *C12N 15/81* | (2006.01) | |

(52) U.S. Cl.
CPC .............. *C12P 7/42* (2013.01); *C12N 15/70* (2013.01); *C12N 15/74* (2013.01); *C12N 15/81* (2013.01); *C12N 15/8222* (2013.01); *C12N 2330/51* (2013.01); *C12N 2800/40* (2013.01); *C12Y 101/01034* (2013.01); *C12Y 101/01157* (2013.01); *C12Y 103/01038* (2013.01); *C12Y 103/03* (2013.01); *C12Y 121/03007* (2015.07); *C12Y 121/03008* (2015.07); *C12Y 203/01009* (2013.01); *C12Y 203/01016* (2013.01); *C12Y 203/01206* (2015.07); *C12Y 203/0301* (2013.01); *C12Y 203/03008* (2013.01); *C12Y 205/01001* (2013.01); *C12Y 207/01036* (2013.01); *C12Y 207/04002* (2013.01); *C12Y 401/01033* (2013.01); *C12Y 402/01017* (2013.01); *C12Y 404/01026* (2015.07); *C12Y 503/03002* (2013.01); *C12Y 604/01002* (2013.01)

(58) Field of Classification Search
CPC .............. C12N 15/1044; C12N 15/70; C12Y 121/03008
See application file for complete search history.

(56) References Cited

U.S. PATENT DOCUMENTS

| | | | |
|---|---|---|---|
| 8,697,654 B2 * | 4/2014 | Cheng | ............ A61Q 5/00 514/21.3 |
| 8,884,100 B2 | 11/2014 | Page et al. | |
| 9,822,384 B2 | 11/2017 | Poulos et al. | |
| 9,856,460 B2 * | 1/2018 | Dueber | ................ C12N 15/62 |
| 2003/0143562 A1 * | 7/2003 | Anderson | .......... C12N 15/1034 435/6.12 |
| 2005/0204419 A1 * | 9/2005 | Helgeson | ............. C07K 14/415 800/279 |
| 2011/0145940 A1 | 6/2011 | Voytas et al. | |
| 2012/0144523 A1 | 6/2012 | Page et al. | |
| 2013/0130347 A1 * | 5/2013 | Delisa | .................. C12N 15/115 435/348 |
| 2013/0164808 A1 * | 6/2013 | McAuliffe | ..... C12Y 205/01001 435/167 |
| 2014/0370595 A1 | 12/2014 | Dueber et al. | |
| 2016/0010126 A1 | 1/2016 | Poulos et al. | |
| 2017/0139496 A1 * | 5/2017 | Kang | .................. G06F 3/04886 |
| 2017/0166950 A1 * | 6/2017 | Wolkowicz | ............. C12Q 1/37 |
| 2019/0055314 A1 * | 2/2019 | Luo | .................... A61K 39/3955 |

FOREIGN PATENT DOCUMENTS

| | | | |
|---|---|---|---|
| WO | WO 2014113738 | 7/2014 | |
| WO | WO 2015196275 | 12/2015 | |
| WO | WO 2016010827 | 1/2016 | |
| WO | WO 2017139496 | 8/2017 | |
| WO | WO-2017139496 A1 * | 8/2017 | ........... C12N 9/1029 |
| WO | WO 2018200888 | 11/2018 | |

OTHER PUBLICATIONS

Carvalho et al. (2017) Designing microorganisms for heterologous biosynthesis of cannabinoids, FEMS Yeast Tes., vol. 17, pp. 1-11.*
Andre et al. (2016) Cannabissativa:ThePlantoftheThousandandOn eMolecules, Frontiers Plant Sci., vol. 7, article 19, pp. 1-15.*
Proschel et al. (2015) Engineering of metabolic pathways by artificial enzyme channels, Frontiers Bioeng. Biotechnol., vol. 3, Article 168, pp. 1-13.*
Klein et al. (2014) Design and characterization of structured protein linkers with differing flexibilities, Prot. Eng. Design Select., vol. 27, No. 10, pp. 325-330.*
Quintero et al. (2007) An improved system for estradiol-dependent regulation of gene expression in yeast, Mlcrob. Cell Factor., vol. 6, No. 10, pp. 1-9.*
Horn et al. (2015) Synthetic Protein Scaffolds Based on Peptide Motifs and Cognate Adaptor Domains for Improving Metabolic Productivity, Front. Bioeng. Biotechnol., vol. 3, Aricle 191, pp. 1-7.*
Redden et al, (2015) The synthetic biology toolbox for tuning gene expression in yeast, FEMS Yest Res., vol. 15, pp. 1-10.*
Becker et al., "High-Efficiency Transformation of Yeast by Electroporation," Meth. Enzymology, 1991, 194:182-187.
Carvalho et al., "Designing microorganisms for heterologous biosynthesis of cannabinoids." FEMS Yeast Research, Jun. 2017, 17(4):fox037, 11 pages.

(Continued)

*Primary Examiner* — Karen Cochrane Carlson
(74) *Attorney, Agent, or Firm* — Fish & Richardson P.C.

(57) ABSTRACT

This document relates to using bidirectional, multi-enzymatic scaffolds to biosynthesize cannabinoids in recombinant hosts.

26 Claims, 121 Drawing Sheets

Specification includes a Sequence Listing.

(56) References Cited

OTHER PUBLICATIONS

Chen et al., "Fusion protein linkers: Property, design and functionality." Adv. Drug Deliv. Reviews, Oct. 2013, 65(10):1357-1369.
Cho et al., "Targeted genome engineering in human cells with the Cas9 RNA-guided endonuclease," Nat. Biotechnology. Mar. 2013, 31(3):230-232.
Christian et al., "Targeting DNA Double-Strand Breaks with TAL Effector Nucleases," Genetics, Oct. 1, 2010, 186(2):757-761.
Cong et al., "Multiplex Genome Engineering Using CRISPR/Cas Systems," Science, Feb. 15, 2013, 339(6121):819-823.
Dicarlo et al., "Genome engineering in Saccharomyces cerevisiae using CRISPR-Cas systems," Nucleic Acids Research, Apr. 2013, 41(7):4336-4343.
Dinkel et al., "The eukaryotic linear motif resource ELM: 10 years and counting," Nucleic Acids Research, Jan. 2014, 42(Database issue):D259-D266.
Dueber et al., "Synthetic protein scaffolds provide modular control over metabolic flux," Nat. Biotechnology, Aug. 2009, 27(8):753-759.
Durrens et al., "Expression of the avian gag-myc oneogene in Saccharomyces cerevisiae," Curr. Genetics, Jul. 1990, 18(1):7-12.
Gagne, et al., "Identification of olivetolic acid cyclase from Cannabis sativa reveals a unique catalytic route to plant polyketides," Proc. Natl. Acad. Sci. USA, Jul. 31, 2012, 109(31): 12811-12816.
GenBank Accession No. AAA52679.1, "3-hydroxy-3-methylglutaryl coenzyme A reductase [Homo sapiens]," dated Nov. 8, 1994, 2 pages.
GenBank Accession No. AAA62411.1. "3-hydroxy-3-methylglutaryl coenzyme A synthase [Homo sapiens]," dated Feb. 24, 1995, 1 page.
GenBank Accession No. AAA74463.1, "ATP citrate-lyase [Rattus norvegicus]." dated Aug. 18, 1995, 1 page.
GenBank Accession No. AAC49920.1, "isopentenyl diphosphate:dimethylallyl diphosphate isomerase [Arabidopsis thaliana]," dated Feb. 24, 1998, 1 page.
GenBank Accession No. AAC50440.1, "mevalonate pyrophosphate decarboxylase [Homo sapiens]," dated Apr. 16, 1996, 1 page.
GenBank Accession No. AAC67348.1, "mevalonate diphosphate decarboxylase [Arabidopsis thaliana]," dated Mar. 11, 2002, 1 page.
GenBank Accession No. AAD31719.1, "mevalonate kinase [Arabidopsis thaliana]," dated May 10, 2000, 1 page.
GenBank Accession No. AAF82407.1, "mevalonate kinase [Homo sapiens]," dated Jun. 10, 2016, 1 page.
GenBank Accession No. AAH06089.1, "Phosphomevalonate kinase [Homo sapiens]," dated Oct. 19, 2016, 2 pages.
GenBank Accession No. AAH10004.1, "Farnesyl diphosphate svntliase (famesyl pyrophosphate synthetase, dimethylallyltranstransferase, geranyltranstransferase) [Homo sapiens]," dated Jul. 15, 2006, 2 pages.
GenBank Accession No. AAH30985.1, "Malonyl CoA:ACP acyltransferase (mitochondrial) [Homo sapiens]," dated Sep. 8, 2006, 2 pages.
GenBank Accession No. AAH31149.1, "Crk protein [Mus musculus]." dated Oct. 7, 2003. 2 pages.
GenBank Accession No. AAK56081.1, "ATP citrate lyase [Mus musculus]," dated Feb. 21, 2002, 1 page.
GenBank Accession No. AAK79760.1, "1-deoxy-D-xylulose 5-phosphate reductoisomerase [Clostridium acetobutylicum ATCC 824]," dated Jan. 30, 2014, 1 page.
GenBank Accession No. AAK80036.1. "Deoxyxylulose-5-phosphate synthase [Clostridium acetobutylicum ATCC 824]," dated Jan. 30, 2014, 1 page.
GenBank Accession No. AAK80816.1, "Acetyl-CoA acetyltransferase [Clostridium acetobutylicum ATCC 824]," dated Jan. 30, 2014, 1 page.
GenBank Accession No. AAK80844.1, "Isopentenyl monophosphate kinase, IPK [Clostridium acetobutylicum ATCC 824]," dated Jan. 30, 2014, 1 page.
GenBank Accession No. AAK81121.1, "4-diphosphocytidyl-2-methylerithritol synthase (Sugar Nucleotide Phosphorylase family) [Clostridium acetobutylicum ATCC 824]," dated Jan. 30, 2014, 1 page.
GenBank Accession No. AAM61343.1, "1-deoxy-D-xylulose 5-phosphate reductoisomerase DXR [Arabidopsis thaliana]," dated Jan. 27, 2006, 1 page.
GenBank Accession No. AAM67058.1, "acetoacyl-CoA-thiolase [Arabidopsis thaliana]," dated Jan. 27, 2006, 1 page.
GenBank Accession No. AAN17431.1, "putative 3-hydroxybutyryl-CoA dehydrogenase [Arabidopsis thaliana]," dated Sep. 24, 2002, 2 pages.
GenBank Accession No. AAN81487.1, "1-hydroxy-2-methyl-2-(E)-butenyl 4-diphosphate synthase [Escherichia coli CFT073]," dated Jan. 31, 2014, 1 page.
GenBank Accession No. AAP35407.1, "isopentenyl-diphosphate delta isomerase [Homo sapiens]," dated May 13, 2003, 1 page.
GenBank Accession No. AAP86010.1, "putative enoyl-(ACP) reductase (plasmid) [Cupriavidus necator H16]," dated Jul. 25, 2016, 1 page.
GenBank Accession No. AAP94122.1, "acetyl-CoA carboxylase 1 [Homo sapiens]," dated Jul. 27, 2003, 2 pages.
GenBank Accession No. AAS11086.1, "acetyl-CoA carboxylase, biotin carboxylase [Treponema denticola ATCC 35405]," dated Jan. 31, 2014, 2 pages.
GenBank Accession No. AAS11105.1, "3-hydroxyacyl-CoA dehydrogenase, putative [Treponema denticola ATCC 35405]," dated Jan. 31, 2014, 2 pages.
GenBank Accession No. AAS11585.1, "hydroxymethylbutenryl pyrophosphate reductase [Treponema denticola ATCC 35405]," dated Jan. 31, 2014, 2 pages.
GenBank Accession No. AAS11783.1, "1-hydroxy-2-methyl-2-(E)-butenyl 4-diphosphate synthase [Treponema denticola ATCC 3 5405]," dated Jan. 31, 2014, 2 pages.
GenBank Accession No. AAS11855.1, "4-diphosphocytidyl-2C-methyl-D-ervihritol kinase [Treponema denticola ATCC 35405]," dated Jan. 31, 2014, 2 pages.
GenBank Accession No. AAS12424.1, "1-deoxy-D-xylulose-5-phosphate synthase [Treponema denticola ATCC 35405]," dated Jan. 31, 2014, 2 pages.
GenBank Accession No. AAS12810.1, "2-C-methyl-D-ervthritol 4-phosphate cytidvlvitransferase [Treponema denticola ATCC 35405]," dated Jan. 31, 2014, 2 pages.
GenBank Accession No. AAS12811.1, "2C-methyl-D-erythritol 2,4-cyclodiphosphate synthase [Treponema denticola ATCC 35405]," dated Jan. 31, 2014, 2 pages.
GenBank Accession No. AAS12860.1, "1-deoxy-D-xylulose 5-phosphate reductoisomerase [Treponema denticola ATCC 35405]," dated Jan. 31, 2014, 2 pages.
GenBank Accession No. AC157384.3, "Bos taurus clone CH240-61D19, Working Draft Sequence, 6 unordered pieces," dated Jul. 11, 2008, 46 pages.
GenBank Accession No. ACJ56139.1, "Geranyltranstransferase(Farnesyl-diphosphate synthase)[Acinetobacter baumannii AB307-0294]," dated Jan. 31, 2014, 1 page.
GenBank Accession No. ACJ57023.1, "Enoyl-CoA hydratase [Acinetobacter baumannii AB307-0294]," dated Jan. 31, 2014, 1 page.
GenBank Accession No. ACJ58210.1, "4-hydroxy-3-methylbut-2-en-1-yl diphosphate synthase [Acinetobacter baumannii AB307-0294]," dated Jan. 31, 2014, 2 pages.
GenBank Accession No. ACJ59227.1, "2C-methyl-D-erythritol 2,4-cyclodiphosphate synthase [Acinetobacter baumannii AB307-0294]," dated Jan. 31, 2014, 1 page.
GenBank Accession No. ACS85236.1, "malonyl CoA-acyl earner protein transacylase [Dickeya paradisiaca Ech703]," dated Oct. 25, 2017, 1 page.
GenBank Accession No. ADI91469.1, "enoyl-CoA hydratase [Acinetobacter oleivorans DR1]," dated Jan. 30, 2014, 1 page.
GenBank Accession No. AEC07908.1, "4-(cytidine 5'-phospho)-2-C-methyl-D-erithritol kinase [Arabidopsis thaliana]," dated Jul. 20, 2017, 2 pages.

(56) References Cited

OTHER PUBLICATIONS

GenBank Accession No. AED97354.1, "4-hydroxy-3-methylbut-2-enyl diphosphate synthase [*Arabidopsis thaliana*]," dated Jul. 20, 2017, 3 pages.
GenBank Accession No. AEE35849.1, "hydroxy methylglutaryl CoA reductase 1 [*Arabidopsis thaliana*]," dated Jul. 20, 2017, 4 pages.
GenBank Accession No. AEE83052.1, "hydroxymethylglutaryl-CoA synthase / HMG-CoA synthase/ 3-hydroxy-3-methylglutaryl coenzyme A synthase [*Arabidopsis thaliana*]," dated Jul. 20, 2017, 3 pages.
GenBank Accession No. AEE86362.1, "4-hydroxy-3-methylbut-2-enyl diphosphate reductase [*Arabidopsis thaliana*]," dated Jul. 20, 2017, 4 pages.
GenBank Accession No. AFD33345.1, "acyl-activating enzyme 1 [*Cannabis sativa*]," dated Aug. 1, 2012, 1 page.
GenBank Accession No. AFD33347.1, "acyl-activating enzyme 3 [*Cannabis sativa*]," dated Aug. 1, 2012, 1 page.
GenBank Accession No. AFN42527.1, "olivetolic acid cyclase [*Cannabis sativa*]," dated Aug. 2, 2012, 1 page.
GenBank Accession No. AGO55277.1, "polyketide biosynthesis malonyl CoA-acyl carrier protein transacylase BaeC [Serratia plymuthica 4Rx13]," dated Jan. 30, 2014, 2 pages.
GenBank Accession No. AHM22925.1, "2-C-methyl-D-erythritol 2,4-cyclodiphosphate synthase [Nicotiana tabacum]," dated Mar. 22, 2014, 1 page.
GenBank Accession No. AIE72439.1. "trans-2-enoyl-CoA reductase (plasmid) [Klebsiella michiganensis]," dated Jul. 8, 2016, 2 pages.
GenBank Accession No. AIZ91493.1, "3-hydroxyacyl-CoA dehydrogenase [*Escherichia coli* str. K-12 substr. MG1655]," dated Dec. 15, 2014, 2 pages.
GenBank Accession No. ALI39443.1, "acetyl-CoA acetyltransferase [*Escherichia coli* str. K-12 substr. MG1655]," dated Dec. 16, 2015, 2 pages.
GenBank Accession No. AMC97367.1, "pyruvate dehydrogenase [*Escherichia coli* str. K-12 substr. MG1655]," dated Feb. 2, 2016, 2 pages.
GenBank Accession No. ANM65835.1, "1-deoxy-D-xylulose 5-phosphate synthase 1 [*Arabidopsis thaliana*]," dated Jul. 20, 2017, 2 pages.
GenBank Accession No. AUG14916.1, "dihydrolipoyllysine-residue acetyltransferase component of pyruvate dehydrogenase complex [*Escherichia coli* str. K-12 substr. MG1655]," dated Dec. 17, 2017, 2 pages.
GenBank Accession No. BAA21534.1, "N-WASP [Rattus rattus]," dated Dec. 27, 2006, 1 page.
GenBank Accession No. BAB00624.1, "ATP citrate-lyase [Ciona intestinalis]," dated Jul. 15, 2000, 1 page.
GenBank Accession No. BAB21592.1, "2-C-methyl-D-erythritol 4-phosphate cytidyltransferase [*Arabidopsis thaliana*]," dated Feb. 14, 2004, 1 page.
GenBank Accession No. BAC41356.1, "tetrahydrocannabinolic acid synthase precursor [*Cannabis sativa*]," dated Sep. 15, 2004, 1 page.
GenBank Accession No. BAF65033.1, "cannabidiolic acid synthase [*Cannabis sativa*]," dated Jun. 29, 2007, 1 page.
GenBank Accession No. BAG14339.1, "olivetol synthase [*Cannabis sativa*]," dated Jun. 20, 2009, 1 page.
GenBank Accession No. CAJ92573.1, "Acetyl-CoA acetyltransferase [Cupriavidus necator H16]," dated Mar. 7, 2015, 2 pages.
GenBank Accession No. CA91294.1, "Enoyl-CoA hydratase [Cupriavidus necator H16]," dated Mar. 7, 2015, 2 pages.
GenBank Accession No. CAJ92510.1. "pyruvate dehydrogenase complex, dehydrogenase (E1) component [Cupriavidus necator H16]," dated Mar. 7, 2015, 2 pages.
GenBank Accession No. CAJ92511.1, "dihydrolipoamide acetyltransferase (E2) component of pyruvate dehydrogenase complex [Cupriavidus necator H16]," dated Mar. 7, 2015, 2 pages.
GenBank Accession No. CAQ66339.1, "Phosphomevalonate kinase [Lactobacillus casei BL23]," dated Feb. 27, 2015, 2 pages.
GenBank Accession No. CAQ66617.1, "Pyruvate dehydrogenase complex, E1 component, alpha subunit [Lactobacillus casei BL23]," dated Feb. 27, 2015, 2 pages.
GenBank Accession No. CAQ66619.1, "Puruvate dehydrogenase complex, E2 component, dihydrolipoamide acetyltransferase [Lactobacillus casei BL23]," dated Feb. 27, 2015, 2 pages.
GenBank Accession No. CAQ66794.1, "Mevalonate kinase [Lactobacillus casei BL23]," dated Feb. 27, 2015, 2 pages.
GenBank Accession No. CAQ66795.1, "Diphosphomevalonate decarboxylase [Lactobacillus casei BL23]," dated Feb. 27, 2015, 2 pages.
GenBank Accession No. CAQ66796.1, "Isopentenyl-diphosphate delta-isomerase (IPP isomerase) (Isopentenyl pyrophosphate isomerase) [Lactobacillus casei BL23]," dated Feb. 27, 2015, 2 pages.
GenBank Accession No. CAQ66932.1, "Farnesyl-diphosphate synthase [Lactobacillus casei BL23]," dated Feb. 27, 2015, 2 pages.
GenBank Accession No. CAQ67081.1, "Hydroxymethylglutaryl-CoA synthase [Lactobacillus casei BL23]," dated Feb. 27, 2015, 2 pages.
GenBank Accession No. CAQ67082.1, "Hydroxymethylglutaryl-CoA reductase [Lactobacillus casei BL23]," dated Feb. 27, 2015, 2 pages.
GenBank Accession No. CAQ67083.1, "Acetyl-CoA acetyltransferase (Acetoacetyl-CoA thiolase) [Lactobacillus casei BL23]," dated Feb. 27, 2015, 2 pages.
GenBank Accession No. CAQ67359.1, "Biotin carboxylase [Lactobacillus casei BL2 3]," dated Feb. 27, 2015, 2 pages.
GenBank Accession No. CDH63564.1, "4-hydroxy-3-methylbut-2-enyl diphosphate reductase [*Escherichia coli* PMV-1]," dated Sep. 18, 2013, 2 pages.
GenBank Accession No. CDH63708.1, "1-deoxy-D-xylulose 5-phosphate reductoisomerase [*Escherichia coli* PMV-1]," dated Sep. 18, 2013, 1 page.
GenBank Accession No. CDH63925.1, "1-deoxy-D-xylulose-5-phosphate synthase [*Escherichia coli* PMV-1]," dated Sep. 18, 2013, 1 page.
GenBank Accession No. CDH64802.1, "4-diphosphocytidyl-2-C-methyl-D-erythritol kinase [*Escherichia coli* PMV-1]," dated Sep. 18, 2013, 1 page.
GenBank Accession No. CDH66379.1, "2-C-methyl-D-erythritol 2.4-cyclodiphosphate synthase [*Escherichia coli* PMV-1]," dated Sep. 18, 2013, 2 pages.
GenBank Accession No. CDH66380.1, "2-C-methyl-D-erythritol 4-phosphate cytidylyltransferase [*Escherichia coli* PMV-1]," dated Sep. 18, 2013, 1 page.
GenBank Accession No. DAA07148.1, "TPA: Etrlp [*Saccharomyces cerevisiae* S288C]," dated Mar. 27, 2017, 2 pages.
GenBank Accession No. DAA07337.1, "TPA: pyruvate dehydrogenase (acetyl-transferring) subunit E1 beta [*Saccharomyces cerevisiae* S288C]," dated Mar. 27, 2017, 2 pages.
GenBank Accession No. DAA10474.1, "TPA: dihydrolipoyllysine-residue acetyltransferase [*Saccharomyces cerevisiae* S288C]," dated Mar. 27, 2017, 2 pages.
GenBank Accession No. DAA10992.1, "TPA: [acyl-carrier-protein] S-malonyltransferase [*Saccharomyces cerevisiae* S288C]," dated Mar. 27, 2017, 2 pages.
GenBank Accession No. EAZ63544.2, "Phosphomevalonate kinase [Scheffersomyces stipitis CBS 6054]," dated Jul. 11, 2011, 2 pages.
GenBank Accession No. EDL06069.1, "syntrophin, acidic 1, isoform CRA_b [Mus musculus]," dated Jul. 26, 2016, 2 pages.
GenBank Accession No. J04537.1, "*Arabidopsis thaliana* HMG-CoA reductase (HMG1) mRNA, complete cds," dated Sep. 29, 2015, 2 pages.
GenBank Accession No. JN717233.1, "*Cannabis sativa* acyl-activating enzyme 1 mRNA. complete cds," dated Aug. 1, 2012, 2 pages.
Havranek et al., "Automated design of specificity in molecular recognition," Nat. Struct. Biology, Jan. 2003, 10(1):45-52.
Horn et al., "Synthetic Protein Scaffolds Based on Peptide Motifs and Cognate Adaptor Domains for Improving Metabolic Productivity," Front. Bioeng. Biotechnology, Nov. 2015, 3:191, 7 pages.
Hwang et al., "Efficient genome editing in zebrafish using a CRISPR-Cas system," Nat. Biotechnology, Mar. 2013, 31(3):227-229.

(56) References Cited

OTHER PUBLICATIONS

Ito et al., "Transformation of Intact Yeast Cells Treated with Alkali Cations," J. Bacteriology, Jan. 1983, 15.3(1):163-168.
Jiang et al., "RNA-guided editing of bacterial genomes using CRISPR-Cas systems," Nat. Biotechnology, Jan. 29, 2013, 31(3):233-239.
Jiang et al., "Manipulation of GES and ERG20 for geraniol overproduction in *Saccharomyces cerevisiae*," Metab. Engineering. May 2017, 41:57-66.
Jinek et al., "A Programmable Dual-RNA—Guided DNA Endonuclease in Adaptive Bacterial Immunity," Science, Aug. 17, 2012, 337(6096):816-821.
Kim et al., "Optimization of hexanoic acid production in recombinant *Escherichia coli* by precise flux rebalancing," Bioresour. Technology, Jan. 2018, 247:1253-1257.
Makarova et al., "Evolution and classification of the CRISPR—Cas systems," Nat. Rev. Microbiology, Jun. 2011, 9(6):467-477.
Mali et al., "RNA-Guided Human Genome Engineering via Cas9," Science, Feb. 15, 2013, 339(6121):823-826.
PCT International Search Report and Written Opinion in International Appln. No. PCT/US2019/063029, dated Feb. 6, 2020, 9 pages.
Proschel et al., "Engineering of metabolic pathways by artificial enzyme channels," Front. Bioeng. Biotechnology, Oct. 2015, 3:168, 13 pages.
Reinke et al., "A Synthetic Coiled-Coil Interactome Provides Heterospecific Modules for Molecular Engineering," J. Am. Chem. Society, Apr. 13, 2010, 132(17):6025-6031.
Rodriguez et al., "ATP citrate lyase mediated cytosolic acetyl-CoA biosynthesis increases mevalonate production in *Saccharomyces cerevisiae*," Microb. Cell Factories, Mar. 2016, 15:48, 12 pages.
Sirikantaramas et al., "The Gene Controlling Marijuana Psychoactivity." J. Biol. Chemistry, Jun. 9, 2004, 279(38):39767-39774.
Song et al., "Engineering *Saccharomyces cerevisiae* for geranylgeraniol overproduction by combinatorial design," Sci. Reports, Nov. 8, 2017, 7:14991, 11 pages.
Stout et al.. "The hexanoyl-CoA precursor for cannabinoid biosynthesis is formed by an acyl-activating enzyme in *Cannabis sativa* trichomes," Plant Journal, Aug. 2012, 71(3):353-365.
Taura et al., "Cannabidiolic-acid synthase, the chemotype-determining enzyme in the fiber-type *Cannabis sativa*," FEBS Letters, Jun. 2007, 581(16):2929-2934.
Taura et al., "Characterization of olivetol synthase, a polyketide synthase putatively involved in cannabinoid biosynthetic pathway," FEBS Letters, Jun. 2009, 583(12):2061-2066.
Teyra et al., "Elucidation of the binding preferences of peptide recognition modules: SH3 and PDZ domains," FEBS Letters, Jun. 2012, 586(17):2631-2637.
Whitaker et al., "Metabolic Pathway Flux Enhancement by Synthetic Protein Scaffolding," Meth. Enzymology, 2011, 497(Part A):447-468.
Zakeri et al., "Peptide tag forming a rapid covalent bond to a protein, through engineering a bacterial adhesin," Proc. Natl. Acad. Sci. USA, Mar. 20, 2012, 109(12):E690-E697.
EP Extended Search Report in European Appln. No. 19888674.9, dated Jul. 22, 2022, 6 pages.

\* cited by examiner

Figure 6A

ATP Citrate Lyase

MSAKAISEQTGKELLYKFICTTSAIQNRFKYARVTPDTDWARLLQDHPWLLSQNLVVKPDQLIKRRGKLGLVGVNLTL
DGVKSWLKPRLGQEATVGKATGFLKNFLIEPFVPHSQAEEFYVCIYATREGDYVLFHHEGGVDVGDVDAKAQKLLV
GVDEKLNPEDIKKHLLVHAPEDKKEILASFISGLFNFYEDLYFTYLEINPLVVTKDGVYVLDLAAKVDATADYICKVKWG
DIEFPPPFGREAYPEEAYIADLDAKSGASLKLTLLNPKGRIWTMVAGGGASVVYSDTICDLGGVNELANYGEYSGAP
SEQQTYDYAKTILSLMTREKHPDGKILIIGGSIANFTNVAATFKGIVRAIRDYQGPLKEHEVTIFVRRGGPNYQEGLRV
MGEVGKTTGIPIHVFGTETHMTAIVGMALGHRPIPNQPPTAAHTANFLLNASGSTSTPAPSRTASFSESRADEVAPAK
KAKPAMPQDSVPSPRSLQGKSTTLFSRHTKAIVWGMQTRAVQGMLDFDYVCSRDEPSVAAMVYPFTGDHKQKFY
WGHKEILIPVFKNMADAMRKHPEVDVLINFASLRSAYDSTMETMNYAQIRTIAIIAEGIPEALTRKLIKKADQKGVTIIGP
ATVGGIKPGCFKIGNTGGMLDNILASKLYRPGSVAYVSRSGGMSNELNNIISRTTDGVYEGVAIGGDRYPGSTFMDH
VLRYQDTPGVKMIVVLGEIGGTEEYKICRGIKEGRLTKPIVCWCIGTCATMFSSEVQFGHAGACANQASETAVAKNQ
ALKEAGVFVPRSFDELGEIIQSVYEDLVANGVIVPAQEVPPPTVPMDYSWARELGLIRKPASFMTSICDERGQELIYA
GMPITEVFKEEMGIGGVLGLLWFQKRLPKYSCQFIEMCLMVTADHGPAVSGAHNTIICARAGKDLVSSLTSGLLTIGD
RFGGALDAAAKMFSKAFDSGIIPMEFVNKMKKEGKLIMGIGHRVKSINNPDMRVQILKDYVRQHFPATPLLDYALEVE
KITTSKKPNLILNVDGLIGVAFVDMLRNCGSFTREEADEYIDIGALNGIFVLGRSMGFIGHYLDQKRLKQGLYRHPWD
DISYVLPEHMSM

Acetyl-CoA Acetyltransferase (atoB)

MKNCVIVSAVRTAIGSFNGSLASTSAIDLGATVIKAAIERAKIDSQHVDEVIMGNVLQAGLGQNPARQALLKSGLAETV
CGFTVNKVCGSGLKSVALAAQAIQAGQAQSIVAGGMENMSLAPYLLDAKARSGYRLGDGQVYDVILRDGLMCATH
GYHMGITAENVAKEYGITREMQDELALHSQRKAAAAIESGAFTAEIVPVNVVTRKKTFVFSQDEFPKANSTAEALGAL
RPAFDKAGTVTAGNASGINDGAAALVIMEESAALAAGLTPLARIKSYASGGVPPALMGMGPVPATQKALQLAGLQLA
DIDLIEANEAFAAQFLAVGKNLGFDSEKVNVNGGAIALGHPIGASGARILVTLLHAMQARDKTLGLATLCIGGGQGIAM
VIERLN

3-Hydroxybutyryl-CoA Dehydrogenase

MKKVCVIGAGTMGSGIAQAFAAKGFEVVLRDIKDEFVDRGLDFINKNLSKLVKKGKIEEATKVEILTRISGTVDLNMAA
DCDLVIEAAVERMDIKKQIFADLDNICKPETILASNTSSLSITEVASATKRPDKVIGMHFFNPAPVMKLVEVIRGIATSQE
TFDAVKETSIAIGKDPVEVAEAPGFVVNRILIPMINEAVGILAEGIASVEDIDKAMKLGANHPMGPLELGDFIGLDICLAI
MDVLYSETGDSKYRPHTLLKKYVRAGWLGRKSGKGFYDYSK

Enoyl-CoA Hydratase

MELNNVILEKEGKVAVVTINRPKALNALNSDTLKEMDYVIGEIENDSEVLAVILTGAGEKSFVAGADISEMKEMNTIEG
RKFGILGNKVFRRLELLEKPVIAAVNGFALGGGCEIAMSCDIRIASSNARFGQPEVGLGITPGFGGTQRLSRLVGMGM
AKQLIFTAQNIKADEALRIGLVNKVVEPSELMNTAKEIANKIVSNAPVAVKLSKQAINRGMQCDIDTALAFESEAFGECF
STEDQKDAMTAFIEKRKIEGFKNR

Trans-Enoyl-CoA Reductase

MIVKPMVRNNICLNAHPQGCKKGVEDQIEYTKKRITAEVKAGAKAPKNVLVLGCSNGYGLASRITAAFGYGAATIGVS
FEKAGSETKYGTPGWYNNLAFDEAAKREGLYSVTIDGDAFSDEIKAQVIEEAKKKGIKFDLIVYSLASPVRTDPDTGIM
HKSVLKPFGKTFTGKTVDPFTGELKEISAEPANDEEAAATVKVMGGEDWERWIKQLSKEGLLEEGCITLAYSYIGPEA
TQALYRKGTIGKAKEHLEATAHRLNKENPSIRAFVSVNKGLVTRASAVIPVIPLYLASLFKVMKEKGNHEGCIEQITRLY
AERLYRKDGTIPVDEENRIRIDDWELEEDVQKAVSALMEKVTGENAESLTDLAGYRHDFLASNGFDVEGINYEAEVE
RFDRI

Figure 6A (continued)

Beta-Ketothiolase (bktB)

MTREVVVVSGVRTAIGTFGGSLKDVAPAELGALVVREALARAQVSGDDVGHVVFGNVIQTEPRDMYLGRVAAVNG
GVTINAPALTVNRLCGSGLQAIVSAAQTILLGDTDVAIGGGAESMSRAPYLAPAARWGARMGDAGLVDMMLGALHD
PFHRIHMGVTAENVAKEYDISRAQQDEAALESHRRASAAIKAGYFKDQIVPVVSKGRKGDVTFDTDEHVRHDATIDD
MTKLRPVFVKENGTVTAGNASGLNDAAAAVVMMERAEAERRGLKPLARLVSYGHAGVDPKAMGIGPVPATKIALER
AGLQVSDLDVIEANEAFAAQACAVTKALGLDPAKVNPNGSGISLGHPIGATGALITVKALHELNRVQGRYALVTMCIG
GGQGIAAIFERI

HMG-CoA Synthase

MKLSTKLCWCGIKGRLRPQKQQQLHNTNLQMTELKKQKTAEQKTRPQNVGIKGIQIYIPTQCVNQSELEKFDGVSQ
GKYTIGLGQTNMSFVNDREDIYSMSLTVLSKLIKSYNIDTNKIGRLEVGTETLIDKSKSVKSVLMQLFGENTDVEGIDTL
NACYGGTNALFNSLNWIESNAWDGRDAIVVCGDIAIYDKGAARPTGGAGTVAMWIGPDAPIVFDSVRASYMEHAYD
FYKPDFTSEYPYVDGHFSLTCYVKALDQVYKSYSKKAISKGLVSDPAGSDALNVLKYFDYNVFHVPTCKLVTKSYGR
LLYNDFRANPQLFPEVDAELATRDYDESLTDKNIEKTFVNVAKPFHKERVAQSLIVPTNTGNMYTASVYAAFASLLNY
VGSDDLQGKRVGLFSYGSGLAASLYSCKIVGDVQHIIKELDITNKLAKRITETPKDYEAAIELRENAHLKKNFKPQGSIE
HLQSGVYYLTNIDDKFRRSYDVKK

Truncated HMG-CoA Reductase

MVAVRRKALSILAEAPVLASDRLPYKNYDYDRVFGACCENVIGYMPLPVGVIGPLVIDGTSYHIPMATTEGCLVASAM
RGCKAINAGGGATTVLTKDGMTRGPVVRFPTLKRSGACKIWLDSEEGQNAIKKAFNSTSRFARLQHIQTCLAGDLLF
MRFRTTTGDAMGMNMISKGVEYSLKQMVEEYGWEDMEVVSVSGNYCTDKKPAAINWIEGRGKSVVAEATIPGDVV
RKVLKSDVSALVELNIAKNLVGSAMAGSVGGFNAHAANLVTAVFLALGQDPAQNVESSNCITLMKEVDGDLRISVSM
PSIEVGTIGGGTVLEPQGAMLDLLGVRGPHATAPGTNARQLARIVACAVLAGELSLCAALAAGHLVQSHMTHNR

Mevalonate Kinase

MSLPFLTSAPGKVIIFGEHSAVYNKPAVAASVSALRTYLLISESSAPDTIELDFPDISFNHKWSINDFNAITEDQVNSQK
LAKAQQATDGLSQELVSLLDPLLAQLSESFHYHAAFCFLYMFVCLCPHAKNIKFSLKSTLPIGAGLGSSASISVSLALA
MAYLGGLIGSNDLEKLSENDKHIVNQWAFIGEKCIHGTPSGIDNAVATYGNALLFEKDSHNGTINTNNFKFLDDFPAIP
MILTYTRIPRSTKDLVARVRVLVTEKFPEVMKPILDAMGECALQGLEIMTKLSKCKGTDDEAVETNNELYEQLLELIRIN
HGLLVSIGVSHPGLELIKNLSDDLRIGSTKLTGAGGGGCSLTLLRRDITQEQIDSFKKKLQDDFSYETFETDLGGTGCC
LLSAKNLNKDLKIKSLVFQLFENKTTTKQQIDDLLLPGNTNLPWTS

Phosphomevalonate Kinase

MSELRAFSAPGKALLAGGYLVLDTKYEAFVVGLSARMHAVAHPYGSLQGSDKFEVRVKSKQFKDGEWLYHISPKSG
FIPVSIGGSKNPFIEKVIANVFSYFKPNMDDYCNRNLFVIDIFSDDAYHSQEDSVTEHRGNRRLSFHSHRIEEVPKTGL
GSSAGG$_{[11]}$LVTVLTTALASFFVSDLENNVDKYREVIHNLAQVAHCQAQGKIGSGFDVAAAAYGSIRYRRFPPALISNL
PDIGSATYGSKLAHLVDEEDWNITIKSNHLPSGLTLWMGDIKNGSETVKLVQKVKNWYDSHMPESLKIYTELDHANS
RFMDGLSKLDRLHETHDDYSDQIFESLERNDCTCQKYPEITEVRDAVATIRRSFRKITKESGADIEPPVQTSLLDDCQ
TLKGVLTCLIPGAGGYDAIAVITKQDVDLRAQTANDKRFSKVQWLDVTQADWGVRKEKDPETYLDK

Figure 6A (continued)

Diphosphomevalonate Decarboxylase

MTVYTASVTAPVNIATLKYWGKRDTKLNLPTNSSISVTLSQDDLRTLTSAATAPEFERDTLWLNGEPHSIDNERTQNC
LRDLRQLRKEMESKDASLPTLSQWKLHIVSENNFPTAAGLASSAAGFAALVSAIAKLYQLPQSTSEISRIARKGSGSA
CRSLFGGYVAWEMGKAEDGHDSMAVQIADSSDWPQMKACVLVVSDIKKDVSSTQGMQLTVATSELFKERIEHVVP
KRFEVMRKAIVEKDFATFAKETMMDSNSFHATCLDSFPPIFYMNDTSKRIISWCHTINQFYGETIVAYTFDAGPNAVL
YYLAENESKLFAFIYKLFGSVPGWDKKFTTEQLEAFNHQFESSNFTARELDLELQKDVARVILTQVGSGPQETNESLI
DAKTGLPKE

Isopentenyl-Diphosphate Delta-Isomerase

MTADNNSMPHGAVSSYAKLVQNQTPEDILEEFPEIIPLQQRPNTRSSETSNDESGETCFSGHDEEQIKLMNENCIVL
DWDDNAIGAGTKKVCHLMENIEKGLLHRAFSVFIFNEQGELLLQQRATEKITFPDLWTNTCCSHPLCIDDELGLKGKL
DDKIKGAITAAVRKLDHELGIPEDETKTRGKFHFLNRIHYMAPSNEPWGEHEIDYILFYKINAKENLTVNPNVNEVRDF
KWVSPNDLKTMFADPSYKFTPWFKIICENYLFNWWEQLDDLSEVENDRQIHRML

Geranyl-Diphosphate Synthase (ERG20$^{ww}$)

MEAKIDELINNDPVWSSQNESLISKPYNHILLKPGKNFRLNLIVQINRVMNLPKDQLAIVSQIVELLHNSSLLIDDIEDNA
PLRRGQTTSHLIWGVPSTINTANYMYFRAMQLVSQLTTKEPLYHWLITIFNEELINLHRGQGLDIYWRDFLPEIIPTQE
MYLNMVMNKTGGLFRLTLRLMEALSPSSHHGHSLVPFINLLGIIYQIRDDYLNLKDFQMSSEKGFAEDITEGKLSFPIV
HALNFTKTKGQTEQHNEILRILLLRTSDKDIKLKLIQILEFDTNSLAYTKNFINQLVNMIKNDNENKYLPDLASHSDTATN
LHDELLYIIDHLSEL

Olivetol Synthase

MNHLRAEGPASVLAIGTANPENILLQDEFPDYYFRVTKSEHMTQLKEKFRKICDKSMIRKRNCFLNEEHLKQNPRLVE
HEMQTLDARQDMLVVEVPKLGKDACAKAIKEWGQPKSKITHLIFTSASTTDMPGADYHCAKLLGLSPSVKRVMMYQ
LGCYGGGTVLRIAKDIAENNKGARVLAVCCDIMACLFRGPSESDLELLVGQAIFGDGAAAVIVGAEPDESVGERPIFE
LVSTGQTILPNSEGTIGGHIREAGLIFDLHKDVPMLISNNIEKCLIEAFTPIGISDWNSIFWITHPGGKAILDKVEEKLHLK
SDKFVDSRHVLSEHGNMSSSTVLFVMDELRKRSLEEGKSTTGDGFEWGVLFGFGPGLTVERVVVRSVPIKY

Olivetolic Acid Cyclase

MAVKHLIVLKFKDEITEAQKEEFFKTYVNLVNIIPAMKDVYWGKDVTQKNKEEGYTHIVEVTFESVETIQDYIIHPAHVG
FGDVYRSFWEKLLIFDYTPRK

CBGA Synthase

MGLSSVCTFSFQTNYHTLLNPHNNNPKTSLLCYRHPKTPIKYSYNNFPSKHCSTKSFHLQNKCSESLSIAKNSIRAAT
TNQTEPPESDNHSVATKILNFGKACWKLQRPYTIIAFTSCACGLFGKELLHNTNLISWSLMFKAFFFLVAILCIASFTTTI
NQIYDLHIDRINKPDLPLASGEISVNTAWIMSIIVALFGLIITIKMKGGPLYIFGYCFGIFGGIVYSVPPFRWKQNPSTAFL
LNFLAHIITNFTFYYASRAALGLPFELRPSFTFLLAFMKSMGSALALIKDASDVEGDTKFGISTLASKYGSRNLTLFCSG
IVLLSYVAAILAGIIWPQAFNSNVMLLSHAILAFWLILQTRDFALTNYDPEAGRRFYEFMWKLYYAEYLVYVFI

Figure 6A (continued)

Acetyl-CoA Carboxylase

MSEESLFESSPQKMEYEITNYSERHTELPGHFIGLNTVDKLEESPLRDFVKSHGGHTVISKILIANNGIAAVKEIRSVRK
WAYETFGDDRTVQFVAMATPEDLEANAEYIRMADQYIEVPGGTNNNNYANVDLIVDIAERADVDAVWAGWGHASE
NPLLPEKLSQSKRKVIFIGPPGNAMRSLGDKISSTIVAQSAKVPCIPWSGTGVDTVHVDEKTGLVSVDDDIYQKGCCT
SPEDGLQKAKRIGFPVMIKASEGGGGKGIRQVEREEDFIALYHQAANEIPGSPIFIMKLAGRARHLEVQLLADQYGTNI
SLFGRDCSVQRRHQKIIEEAPVTIAKAETFHEMEKAAVRLGKLVGYVSAGTVEYLYSHDDGKFYFLELNPRLQVEHP
TTEMVSGVNLPAAQLQIAMGIPMHRISDIRTLYGMNPHSASEIDFEFKTQDATKKQRRPIPKGHCTACRITSEDPNDG
FKPSGGTLHELNFRSSSNVWGYFSVGNNGNIHSFSDSQFGHIFAFGENRQASRKHMVVALKELSIRGDFRTTVEYLI
KLLETEDFEDNTITTGWLDDLITHKMTAEKPDPTLAVICGAATKAFLASEEARHKYIESLQKGQVLSKDLLQTMFPVDF
IHEGKRYKFTVAKSGNDRYTLFINGSKCDIILRQLSDGGLLIAIGGKSHTIYWKEEVAATRLSVDSMTTLLEVENDPTQL
RTPSPGKLVKFLVENGEHIIKGQPYAEIEVMKMQMPLVSQENGIVQLLKQPGSTIVAGDIMAIMTLDDPSKVKHALPFE
GMLPDFGSPVIEGTKPAYKFKSLVSTLENILKGYDNQVIMNASLQQLIEVLRNPKLPYSEWKLHISALHSRLPAKLDEQ
MEELVARSLRRGAVFPARQLSKLIDMAVKNPEYNPDKLLGAVVEPLADIAHKYSNGLEAHEHSIFVHFLEEYYEVEKL
FNGPNVREENIILKLRDENPKDLDKVALTVLSHSKVSAKNNLILAILKHYQPLCKLSSKVSAIFSTPLQHIVELESKATAK
VALQAREILIQGALPSVKERTEQIEHILKSSVVKVAYGSSNPKRSEPDLNILKDLIDSNYVVFDVLLQFLTHQDPVVTAA
AAQVYIRRAYRAYTIGDIRVHEGVTVPIVEWKFQLPSAAFSTFPTVKSKMGMNRAVSVSDLSYVANSQSSPLREGILM
AVDHLDDVDEILSQSLEVIPRHQSSSNGPAPDRSGSSASLSNVANVCVASTEGFESEEEILVRLREILDLNKQELINAS
IRRITFMFGFKDGSYPKYYTFNGPNYNENETIRHIEPALAFQLELGRLSNFNIKPIFTDNRNIHVYEAVSKTSPLDKRFF
TRGIIRTGHIRDDISIQEYLTSEANRLMSDILDNLEVTDTSNSDLNHIFINFIAVFDISPEDVEAAFGGFLERFGKRLLRLR
VSSAEIRIIIKDPQTGAPVPLRALINNVSGYVIKTEMYTEVKNAKGEVWFKSLGKPGSMHLRPIATPYPVKEWLQPKRY
KAHLMGTTYVYDFPELFRQASSSQWKNFSADVKLTDDFFISNELIEDENGELTEVEREPGANAIGMVAFKITVKTPEY
PRGRQFVVVANDITFKIGSFGPQEDEFFNKVTEYARKRGIPRIYLAANSGARIGMAEEIVPLFQVAWNDAANPDKGF
QYLYLTSEGMETLKKFDKENSVLTERTVINGEERFVIKTIIGSEDGLGVECLRGSGLIAGATSRAYHDIFTITLVTCRSV
GIGAYLVRLGQRAIQVEGQPIILTGAPAINKMLGREVYTSNLQLGGTQIMYNNGVSHLTAVDDLAGVEKIVEWMSYVP
AKRNMPVPILETKDTWDRPVDFTPTNDETYDVRWMIEGRETESGFEYGLFDKGSFFETLSGWAKGVVVGRARLGGI
PLGVIGVETRTVENLIPADPANPNSAETLIQEPGQVWHPNSAFKTAQAINDFNNGEQLPMMILANWRGFSGGQRDM
FNEVLKYGSFIVDALVDYKQPIIIYIPPTGELRGGSWVVVDPTINADQMEMYADVNARAGVLEPQGMVGIKFRREKLL
DTMNRLDDKYRELRSQLSNKSLAPEVHQQISKQLADRERELLPIYGQISLQFADLHDRSSRMVAKGVISKELEWTEA
RRFFFWRLRRRLNEEYLIKRLSHQVGEASRLEKIARIRSWYPASVDHEDDRQVATWIEENYKTLDDKLKGLKLESFA
QDLAKKIRSDHDNAIDGLSEVIKMLSTDDKEKLLKTLK

CBDA Synthase

MKCSTFSFWFVCKIIFFFFSFNIQTSIANPRENFLKCFSQYIPNNATNLKLVYTQNNPLYMSVLNSTIHNLRFTSDTTPK
PLVIVTPSHVSHIQGTILCSKKVGLQIRTRSGGHDSEGMSYISQVPFVIVDLRNMRSIKIDVHSQTAWVEAGATLGEVY
YWVNEKNENLSLAAGYCPTVCAGGHFGGGGYGPLMRNYGLAADNIIDAHLVNVHGKVLDRKSMGEDLFWALRGG
GAESFGIIVAWKIRLVAVPKSTMFSVKKIMEIHELVKLVNKWQNIAYKYDKDLLLMTHFITRNITDNQGKNKTAIHTYFS
SVFLGGVDSLVDLMNKSFPELGIKKTDCRQLSWIDTIIFYSGVVNYDTDNFNKEILLDRSAGQNGAFKIKLDYVKKPIP
ESVFVQILEKLYEEDIGAGMYALYPYGGIMDEISESAIPFPHRAGILYELWYICSWEKQEDNEKHLNWIRNIYNFMTPY
VSKNPRLAYLNYRDLDIGINDPKNPNNYTQARIWGEKYFGKNFDRLVKVKTLVDPNNFFRNEQSIPPLPRHRH

CBCA Synthase

MNCSTFSFWFVCKIIFFFLSFNIQISIANPQENFLKCFSEYIPNNPANPKFIYTQHDQLYMSVLNSTIQNLRFTSDTTPK
PLVIVTPSNVSHIQASILCSKKVGLQIRTRSGGHDAEGLSYISQVPFAIVDLRNMHTVKVDIHSQTAWVEAGATLGEVY
YWINEMNENFSFPGGYCPTVGVGGHFSGGGYGALMRNYGLAADNIIDAHLVNVDGKVLDRKSMGEDLFWAIRGGG
GENFGIIAACKIKLVVVPSKATIFSVKKNMEIHGLVKLFNKWQNIAYKYDKDLMLTTHFRTRNITDNHGKNKTTVHGYF
SSIFLGGVDSLVDLMNKSFPELGIKKTDCKELSWIDTTIFYSGVVNYNTANFKKEILLDRSAGKKTAFSIKLDYVKKLIPE
TAMVKILEKLYEEEVGVGMYVLYPYGGIMDEISESAIPFPHRAGIMYELWYTATWEKQEDNEKHINWVRSVYNFTTP
YVSQNPRLAYLNYRDLDLGKTNPESPNNYTQARIWGEKYFGKNFNRLVKVKTKADPNNFFRNEQSIPPLPPRHH

Figure 6A (continued)

Hexanoyl-CoA Synthetase

MGKNYKSLDSVVASDFIALGITSEVAETLHGRLAEIVCNYGAATPQTWINIANHILSPDLPFSLHQMLFYGCYKDFGPA
PPAWIPDPEKVKSTNLGALLEKRGKEFLGVKYKDPISSFSHFQEFSVRNPEVYWRTVLMDEMKISFSKDPECILRRD
DINNPGGSEWLPGGYLNSAKNCLNVNSNKKLNDTMIVWRDEGNDDLPLNKLTLDQLRKRVWLVGYALEEMGLEKG
CAIAIDMPMHVDAVVIYLAIVLAGYVVVSIADSFSAPEISTRLRLSKAKAIFTQDHIIRGKKRIPLYSRVVEAKSPMAIVIP
CSGSNIGAELRDGDISWDYFLERAKEFKNCEFTAREQPVDAYTNILFSSGTTGEPKAIPWTQATPLKAAADGWSHLD
IRKGDVIVWPTNLGWMMGPWLVYASLLNGASIALYNGSPLVSGFAKFVQDAKVTMLGVVPSIVRSWKSTNCVSGYD
WSTIRCFSSSGEASNVDEYLWLMGRANYKPVIEMCGGTEIGGAFSAGSFLQAQSLSSFSSQCMGCTLYILDKNGYP
MPKNKPGIGELALGPVMFGASKTLLNGNHHDVYFKGMPTLNGEVLRRHGDIFELTSNGYYHAHGRADDTMNIGGIKI
SSIEIERVCNEVDDRVFETTAIGVPPLGGGPEQLVIFFVLKDSNDTTIDLNQLRLSFNLGLQKKLNPLFKVTRVVPLSSL
PRTATNKIMRRVLRQQFSHFE

Figure 6B

ATP Citrate Lyase – Enzyme Linker – cTPR6 Spacer – ID Linker – ID1

MSAKAISEQTGKELLYKFICTTSAIQNRFKYARVTPDTDWARLLQDHPWLLSQNLVVKPDQLIKRRGKLGLVGVNLTL
DGVKSWLKPRLGQEATVGKATGFLKNFLIEPFVPHSQAEEFYVCIYATREGDYVLFHHEGGVDVGDVDAKAQKLLV
GVDEKLNPEDIKKHLLVHAPEDKKEILASFISGLFNFYEDLYFTYLEINPLVVTKDGVYVLDLAAKVDATADYICKVKWG
DIEFPPPFGREAYPEEAYIADLDAKSGASLKLTLLNPKGRIWTMVAGGGASVVYSDTICDLGGVNELANYGEYSGAP
SEQQTYDYAKTILSLMTREKHPDGKILIIGGSIANFTNVAATFKGIVRAIRDYQGPLKEHEVTIFVRRGGPNYQEGLRV
MGEVGKTTGIPIHVFGTETHMTAIVGMALGHRPIPNQPPTAAHTANFLLNASGSTSTPAPSRTASFSESRADEVAPAK
KAKPAMPQDSVPSPRSLQGKSTTLFSRHTKAIVWGMQTRAVQGMLDFDYVCSRDEPSVAAMVYPFTGDHKQKFY
WGHKEILIPVFKNMADAMRKHPEVDVLINFASLRSAYDSTMETMNYAQIRTIAIIAEGIPEALTRKLIKKADQKGVTIIGP
ATVGGIKPGCFKIGNTGGMLDNILASKLYRPGSVAYVSRSGGMSNELNNIISRTTDGVYEGVAIGGDRYPGSTFMDH
VLRYQDTPGVKMIVVLGEIGGTEEYKICRGIKEGRLTKPIVCWCIGTCATMFSSEVQFGHAGACANQASETAVAKNQ
ALKEAGVFVPRSFDELGEIIQSVYEDLVANGVIVPAQEVPPPTVPMDYSWARELGLIRKPASFMTSICDERGQELIYA
GMPITEVFKEEMGIGGVLGLLWFQKRLPKYSCQFIEMCLMVTADHGPAVSGAHNTIICARAGKDLVSSLTSGLLTIGD
RFGGALDAAAKMFSKAFDSGIIPMEFVNKMKKEGKLIMGIGHRVKSINNPDMRVQILKDYVRQHFPATPLLDYALEVE
KITTSKKPNLILNVDGLIGVAFVDMLRNCGSFTREEADEYIDIGALNGIFVLGRSMGFIGHYLDQKRLKQGLYRHPWD
DISYVLPEHMSMKLSGGGGSGGGGSGGGGSAEAWYNLGNAYYKQGDYQKAIEYYQKALELDPNNAEAWYNLGNA
YYKQGDYQKAIEYYQKALELDPNNAEAWYNLGNAYYKQGDYQKAIEDYQKALELDPNNLQAEAWKNLGNAYYKQG
DYQKAIEYYQKALELDPNNASAWYNLGNAYYKQGDYQKAIEYYQKALELDPNNAKAWYRRGNAYYKQGDYQKAIE
DYQKALELDPNNRSRSAGGGGSGGGGSGGGGASSYYHHHHHHLESTSLYKKAGSGSNLVAQLENEVASLENENE
TLKKKKNLHKKDLIAYLEKEIANLRKKIEEGSAGSAAGSGEFGSAEAAAKEAAAKAGSAGSAAGSGEFGSSYYHHHHH
HLESTSLYKKAGSGSARNAYLRKKIARLKKDNLQLERDEQNLEKIIANLRDEIARLENEVASHEQ

Acetyl-CoA Acetyltransferase (atoB) – Enzyme Linker – cTPR6 Spacer – ID Linker – ID2

MKNCVIVSAVRTAIGSFNGSLASTSAIDLGATVIKAAIERAKIDSQHVDEVIMGNVLQAGLGQNPARQALLKSGLAETV
CGFTVNKVCGSGLKSVALAAQAIQAGQAQSIVAGGMENMSLAPYLLDAKARSGYRLGDGQVYDVILRDGLMCATH
GYHMGITAENVAKEYGITREMQDELALHSQRKAAAAIESGAFTAEIVPVNVVTRKKTFVFSQDEFPKANSTAEALGAL
RPAFDKAGTVTAGNASGINDGAAALVIMEESAALAAGLTPLARIKSYASGGVPPALMGMGPVPATQKALQLAGLQLA
DIDLIEANEAFAAQFLAVGKNLGFDSEKVNVNGGAIALGHPIGASGARILVTLLHAMQARDKTLGLATLCIGGGQGIAM
VIERLNKLSGGGGSGGGGSGGGGSAEAWYNLGNAYYKQGDYQKAIEYYQKALELDPNNAEAWYNLGNAYYKQGD
YQKAIEYYQKALELDPNNAEAWYNLGNAYYKQGDYQKAIEDYQKALELDPNNLQAEAWKNLGNAYYKQGDYQKAIE
YYQKALELDPNNASAWYNLGNAYYKQGDYQKAIEYYQKALELDPNNAKAWYRRGNAYYKQGDYQKAIEDYQKALE
LDPNNRSRSAGGGGSGGGGSGGGGASSYYHHHHHHLESTSLYKKAGSGSNEVTTLENDAAFIENENAYLEKEIAR
LRKEKAALRNRLAHKKGSAGSAAGSGEFGSAEAAAKEAAAKAGSAGSAAGSGEFGSSYYHHHHHHLESTSLYKKA
GSGSQKVAELKNRVAVKLNRNEQLKNKVEELKNRNAYLKNELATLENEVARLENDVAE

3-Hydroxybutyryl-CoA Dehydrogenase – Enzyme Linker – cTPR6 Spacer – ID Linker – ID3

MKKVCVIGAGTMGSGIAQAFAAKGFEVVLRDIKDEFVDRGLDFINKNLSKLVKKGKIEEATKVEILTRISGTVDLNMAADCDL
VIEAAVERMDIKKQIFADLDNICKPETILASNTSSLSITEVASATKRPDKVIGMHFFNPAPVMKLVEVIRGIATSQETFDAVKET
SIAIGKDPVEVAEAPGFVVNRILIPMINEAVGILAEGIASVEDIDKAMKLGANHPMGPLELGDFIGLDICLAIMDVLYSETGDSK
YRPHTLLKKYVRAGWLGRKSGKGFYDYSKKLSGGGGSGGGGSGGGGSAEAWYNLGNAYYKQGDYQKAIEYYQKALEL
DPNNAEAWYNLGNAYYKQGDYQKAIEYYQKALELDPNNAEAWYNLGNAYYKQGDYQKAIEDYQKALELDPNNLQAEAW
KNLGNAYYKQGDYQKAIEYYQKALELDPNNASAWYNLGNAYYKQGDYQKAIEYYQKALELDPNNAKAWYRRGNAYYKQ
GDYQKAIEDYQKALELDPNNRSRSAGGGGSGGGGSGGGGASENLYFQGENLYFQGDSSESCWNCGRKASETCSGCNT
ARYCGSFCQHKDWEKHHHICGQTLQAQQGSAGSAAGSGEFGSAEAAAKEAAAKAGSAGSAAGSGEFGSMAVSESQLK
KMVSKYKYRDLTVRETVNVITLYKDLKPVLDSYVFNDGSSRELMNLTGTIPVPYRGNTYNIPICLWLLDTYPYNPPICFVKPT
SSMTIKTGKHVDANGKIYLPYLHEWKHPQSDLLGLIQVMIVVFGDEPPVFSRP

Figure 6B (continued)

Enoyl-CoA Hydratase – Enzyme Linker – cTPR6 Spacer – ID Linker – ID4

MELNNVILEKEGKVAVVTINRPKALNALNSDTLKEMDYVIGEIENDSEVLAVILTGAGEKSFVAGADISEMKEMNTIEG
RKFGILGNKVFRRLELLEKPVIAAVNGFALGGGCEIAMSCDIRIASSNARFGQPEVGLGITPGFGGTQRLSRLVGMGM
AKQLIFTAQNIKADEALRIGLVNKVVEPSELMNTAKEIANKIVSNAPVAVKLSKQAINRGMQCDIDTALAFESEAFGECF
STEDQKDAMTAFIEKRKIEGFKNRKLSGGGGSGGGGSGGGGSAEAWYNLGNAYYKQGDYQKAIEYYQKALELDPN
NAEAWYNLGNAYYKQGDYQKAIEYYQKALELDPNNAEAWYNLGNAYYKQGDYQKAIEDYQKALELDPNNLQAEAW
KNLGNAYYKQGDYQKAIEYYQKALELDPNNASAWYNLGNAYYKQGDYQKAIEYYQKALELDPNNAKAWYRRGNAY
YKQGDYQKAIEDYQKALELDPNNRSRSAGGGGSGGGGSGGGGASGPLGSPLTASMLASAPPQEQKQMLGERLFP
LIQAMHPTLAGKITGMLLEIDNSELLHMLESPESLRSKVDEAVAVLQAHQAKEAAQKAGSAGSAAGSGEFGSAEAAA
KEAAAKAGSAGSAAGSGEFGSNTNMSVPTDGAVTTSQIPASEQETLVRPKPLLLKLLKSVGAQKDTYTMKEVLFYLG
QYIMTKRLYDEKQQHIVYCSNDLLGDLFGVPSFSVKEHRKIYTMIYRNLVV

Trans-Enoyl-CoA Reductase – Enzyme Linker – cTPR6 Spacer – ID Linker – ID5

MIVKPMVRNNICLNAHPQGCKKGVEDQIEYTKKRITAEVKAGAKAPKNVLVLGCSNGYGLASRITAAFGYGAATIGVS
FEKAGSETKYGTPGWYNNLAFDEAAKREGLYSVTIDGDAFSDEIKAQVIEEAKKKGIKFDLIVYSLASPVRTDPDTGIM
HKSVLKPFGKTFTGKTVDPFTGELKEISAEPANDEEAAATVKVMGGEDWERWIKQLSKEGLLEEGCITLAYSYIGPEA
TQALYRKGTIGKAKEHLEATAHRLNKENPSIRAFVSVNKGLVTRASAVIPVIPLYLASLFKVMKEKGNHEGCIEQITRLY
AERLYRKDGTIPVDEENRIRIDDWELEEDVQKAVSALMEKVTGENAESLTDLAGYRHDFLASNGFDVEGINYEAEVE
RFDRIKLSGGGGSGGGGSGGGGSAEAWYNLGNAYYKQGDYQKAIEYYQKALELDPNNAEAWYNLGNAYYKQGDY
QKAIEYYQKALELDPNNAEAWYNLGNAYYKQGDYQKAIEDYQKALELDPNNLQAEAWKNLGNAYYKQGDYQKAIEY
YQKALELDPNNASAWYNLGNAYYKQGDYQKAIEYYQKALELDPNNAKAWYRRGNAYYKQGDYQKAIEDYQKALEL
DPNNRSRSAGGGGSGGGGSGGGGASSYYHHHHHHLESTSLYKKAGSGSNLLATLRSTAAVLENENHVLEKEKEKL
RKEKEQLLNKLEAYKGSAGSAAGSGEFGSAEAAAKEAAAKAGSAGSAAGSGEFGSSYYHHHHHHLESTSLYKKAG
SGSKRIAYLRKKIAALKKDNANLEKDIANLENEIERLIKEIKTLENEVASHEQ

Beta-Ketothiolase (bktB) – Enzyme Linker – cTPR6 Spacer – ID Linker – ID6

MTREVVVVSGVRTAIGTFGGSLKDVAPAELGALVVREALARAQVSGDDVGHVVFGNVIQTEPRDMYLGRVAAVNG
GVTINAPALTVNRLCGSGLQAIVSAAQTILLGDTDVAIGGGAESMSRAPYLAPAARWGARMGDAGLVDMMLGALHD
PFHRIHMGVTAENVAKEYDISRAQQDEAALESHRRASAAIKAGYFKDQIVPVVSKGRKGDVTFDTDEHVRHDATIDD
MTKLRPVFVKENGTVTAGNASGLNDAAAAVVMMERAEAERRGLKPLARLVSYGHAGVDPKAMGIGPVPATKIALER
AGLQVSDLDVIEANEAFAAQACAVTKALGLDPAKVNPNGSGISLGHPIGATGALITVKALHELNRVQGRYALVTMCIG
GGQGIAAIFERIKLSGGGGSGGGGSGGGGSAEAWYNLGNAYYKQGDYQKAIEYYQKALELDPNNAEAWYNLGNAY
YKQGDYQKAIEYYQKALELDPNNAEAWYNLGNAYYKQGDYQKAIEDYQKALELDPNNLQAEAWKNLGNAYYKQGD
YQKAIEYYQKALELDPNNASAWYNLGNAYYKQGDYQKAIEYYQKALELDPNNAKAWYRRGNAYYKQGDYQKAIED
YQKALELDPNNRSRSAGGGGSGGGGSGGGGASDVMWEYKWENTGDAELYGPFTSAQMQTWVSEGYFPDGVYC
RKLDPPGGQFYNSKRIDFDLYTGSAGSAAGSGEFGSAEAAAKEAAAKAGSAGSAAGSGEFGSESDSVEFNNAISYV
NKIKTRFLDHPEIYRSFLEILHTYQKEQLHTKGRPFRGMSEEEVFTEVANLFRGQEDLLSEFGQFLPEAKR

Figure 6B (continued)

HMG-CoA Synthase – Enzyme Linker – cTPR6 Spacer – ID Linker – ID7

MKLSTKLCWCGIKGRLRPQKQQQLHNTNLQMTELKKQKTAEQKTRPQNVGIKGIQIYIPTQCVNQSELEKFDGVSQ
GKYTIGLGQTNMSFVNDREDIYSMSLTVLSKLIKSYNIDTNKIGRLEVGTETLIDKSKSVKSVLMQLFGENTDVEGIDTL
NACYGGTNALFNSLNWIESNAWDGRDAIVVCGDIAIYDKGAARPTGGAGTVAMWIGPDAPIVFDSVRASYMEHAYD
FYKPDFTSEYPYVDGHFSLTCYVKALDQVYKSYSKKAISKGLVSDPAGSDALNVLKYFDYNVFHVPTCKLVTKSYGR
LLYNDFRANPQLFPEVDAELATRDYDESLTDKNIEKTFVNVAKPFHKERVAQSLIVPTNTGNMYTASVYAAFASLLNY
VGSDDLQGKRVGLFSYGSGLAASLYSCKIVGDVQHIIKELDITNKLAKRITETPKDYEAAIELRENAHLKKNFKPQGSIE
HLQSGVYYLTNIDDKFRRSYDVKKKLSGGGGSGGGGSGGGGSAEAWYNLGNAYYKQGDYQKAIEYYQKALELDP
NNAEAWYNLGNAYYKQGDYQKAIEYYQKALELDPNNAEAWYNLGNAYYKQGDYQKAIEDYQKALELDPNNLQAEA
WKNLGNAYYKQGDYQKAIEYYQKALELDPNNASAWYNLGNAYYKQGDYQKAIEYYQKALELDPNNAKAWYRRGN
AYYKQGDYQKAIEDYQKALELDPNNRSRSAGGGGSGGGGSGGGGASLGPLPPGWEVRSTVSGRIYFVDHNNRTT
QFTDPRLHGSAGSAAGSGEFGSAEAAAKEAAAKAGSAGSAAGSGEFGSGAMGPLPPGWEKRTDSNGRVYFVNH
NTRITQWEDPRS

Truncated HMG-CoA Reductase – Enzyme Linker – cTPR6 Spacer – ID Linker – ID8

MVAVRRKALSILAEAPVLASDRLPYKNYDYDRVFGACCENVIGYMPLPVGVIGPLVIDGTSYHIPMATTEGCLVASAM
RGCKAINAGGGATTVLTKDGMTRGPVVRFPTLKRSGACKIWLDSEEGQNAIKKAFNSTSRFARLQHIQTCLAGDLLF
MRFRTTTGDAMGMNMISKGVEYSLKQMVEEYGWEDMEVVSVSGNYCTDKKPAAINWIEGRGKSVVAEATIPGDVV
RKVLKSDVSALVELNIAKNLVGSAMAGSVGGFNAHAANLVTAVFLALGQDPAQNVESSNCITLMKEVDGDLRISVSM
PSIEVGTIGGGTVLEPQGAMLDLLGVRGPHATAPGTNARQLARIVACAVLAGELSLCAALAAGHLVQSHMTHNRKLS
GGGGSGGGGSGGGGSAEAWYNLGNAYYKQGDYQKAIEYYQKALELDPNNAEAWYNLGNAYYKQGDYQKAIEYY
QKALELDPNNAEAWYNLGNAYYKQGDYQKAIEDYQKALELDPNNLQAEAWKNLGNAYYKQGDYQKAIEYYQKALE
LDPNNASAWYNLGNAYYKQGDYQKAIEYYQKALELDPNNAKAWYRRGNAYYKQGDYQKAIEDYQKALELDPNNRS
RSAGGGGSGGGGSGGGGASSYYHHHHHHLESTSLYKKAGSEFFRRERNKMAAAKCRNRRRELTDTLQAETDQLE
DEKSALQTEIANLLKEKEKLEFILAAHRPACKIPDDLGFPEEMSLEGSAGSAAGSGEFGSAEAAAKEAAAKAGSAGSA
AGSGEFGSSYYHHHHHHLESTSLYKKAGSGSQKVESLKQKIEELKQRKAQLKNDIANLEKEIAYAET

Mevalonate Kinase – Enzyme Linker – cTPR6 Spacer – ID Linker – ID9

MSLPFLTSAPGKVIIFGEHSAVYNKPAVAASVSALRTYLLISESSAPDTIELDFPDISFNHKWSINDFNAITEDQVNSQK
LAKAQQATDGLSQELVSLLDPLLAQLSESFHYHAAFCFLYMFVCLCPHAKNIKFSLKSTLPIGAGLGSSASISVSLALA
MAYLGGLIGSNDLEKLSENDKHIVNQWAFIGEKCIHGTPSGIDNAVATYGNALLFEKDSHNGTINTNNFKFLDDFPAIP
MILTYTRIPRSTKDLVARVRVLVTEKFPEVMKPILDAMGECALQGLEIMTKLSKCKGTDDEAVETNNELYEQLLELIRIN
HGLLVSIGVSHPGLELIKNLSDDLRIGSTKLTGAGGGGCSLTLLRRDITQEQIDSFKKKLQDDFSYETFETDLGGTGCC
LLSAKNLNKDLKIKSLVFQLFENKTTTKQQIDDLLLPGNTNLPWTSKLSGGGGSGGGGSGGGGSAEAWYNLGNAYY
KQGDYQKAIEYYQKALELDPNNAEAWYNLGNAYYKQGDYQKAIEYYQKALELDPNNAEAWYNLGNAYYKQGDYQK
AIEDYQKALELDPNNLQAEAWKNLGNAYYKQGDYQKAIEYYQKALELDPNNASAWYNLGNAYYKQGDYQKAIEYYQ
KALELDPNNAKAWYRRGNAYYKQGDYQKAIEDYQKALELDPNNRSRSAGGGGSGGGGSGGGGASMEPAMEPET
LEARINRATNPLNKELDWASINGFCEQLNEDFEGPPLATRLLAHKIQSPQEWEAIQALTVLETCMKSCGKRFHDEVG
KFRFLNELIKVVSPKYLGSRTSEKVKNKILELLYSWTVGLPEEVKIAEAYQMLKKQGIVKSGSAGSAAGSGEFGSAEA
AAKEAAAKAGSAGSAAGSGEFGSGAMGSMAEAEGESLESWLNKATNPSNRQEDWEYIIGFCDQINKELEGPQIAV
RLLAHKIQSPQEWEALQALTVLEACMKNCGRRFHNEVGKFRFLNELIKVVSPKYLGDRVSEKVKTKVIELLYSWTMA
LPEEAKIKDAYHMLKRQGIVQSDPPIPVDRTLIPSPPPRPKN

Figure 6B (continued)

Phosphomevalonate Kinase – Enzyme Linker – cTPR6 Spacer – ID Linker – ID10

MSELRAFSAPGKALLAGGYLVLDTKYEAFVVGLSARMHAVAHPYGSLQGSDKFEVRVKSKQFKDGEWLYHISPKSG
FIPVSIGGSKNPFIEKVIANVFSYFKPNMDDYCNRNLFVIDIFSDDAYHSQEDSVTEHRGNRRLSFHSHRIEEVPKTGL
GSSAGG[J2]LVTVLTTALASFFVSDLENNVDKYREVIHNLAQVAHCQAQGKIGSGFDVAAAAYGSIRYRRFPPALISNL
PDIGSATYGSKLAHLVDEEDWNITIKSNHLPSGLTLWMGDIKNGSETVKLVQKVKNWYDSHMPESLKIYTELDHANS
RFMDGLSKLDRLHETHDDYSDQIFESLERNDCTCQKYPEITEVRDAVATIRRSFRKITKESGADIEPPVQTSLLDDCQ
TLKGVLTCLIPGAGGYDAIAVITKQDVDLRAQTANDKRFSKVQWLDVTQADWGVRKEKDPETYLDKKLSGGGGSGG
GGSGGGGSAEAWYNLGNAYYKQGDYQKAIEYYQKALELDPNNAEAWYNLGNAYYKQGDYQKAIEYYQKALELDP
NNAEAWYNLGNAYYKQGDYQKAIEDYQKALELDPNNLQAEAWKNLGNAYYKQGDYQKAIEYYQKALELDPNNASA
WYNLGNAYYKQGDYQKAIEYYQKALELDPNNAKAWYRRGNAYYKQGDYQKAIEDYQKALELDPNNRSRSAGGGG
SGGGGSGGGGASSYYHHHHHHLESTSLYKKAGSGSQKVEELKNKIAELENRNAVKKNRVAHLKQEIAYLKDELAAH
EFEGSAGSAAGSGEFGSAEAAAKEAAAKAGSAGSAAGSGEFGSSYYHHHHHHLESTSLYKKAGSGSFENVTHEFIL
ATLENENAKLRRLEAKLERELARLRNEVAWL

Diphosphomevalonate Decarboxylase – Enzyme Linker – cTPR6 Spacer – ID Linker – ID11

MTVYTASVTAPVNIATLKYWGKRDTKLNLPTNSSISVTLSQDDLRTLTSAATAPEFERDTLWLNGEPHSIDNERTQNC
LRDLRQLRKEMESKDASLPTLSQWKLHIVSENNFPTAAGLASSAAGFAALVSAIAKLYQLPQSTSEISRIARKGSGSA
CRSLFGGYVAWEMGKAEDGHDSMAVQIADSSDWPQMKACVLVVSDIKKDVSSTQGMQLTVATSELFKERIEHVVP
KRFEVMRKAIVEKDFATFAKETMMDSNSFHATCLDSFPPIFYMNDTSKRIISWCHTINQFYGETIVAYTFDAGPNAVL
YYLAENESKLFAFIYKLFGSVPGWDKKFTTEQLEAFNHQFESSNFTARELDLELQKDVARVILTQVGSGPQETNESLI
DAKTGLPKEKLSGGGGSGGGGSGGGGSAEAWYNLGNAYYKQGDYQKAIEYYQKALELDPNNAEAWYNLGNAYYK
QGDYQKAIEYYQKALELDPNNAEAWYNLGNAYYKQGDYQKAIEDYQKALELDPNNLQAEAWKNLGNAYYKQGDYQ
KAIEYYQKALELDPNNASAWYNLGNAYYKQGDYQKAIEYYQKALELDPNNAKAWYRRGNAYYKQGDYQKAIEDYQ
KALELDPNNRSRSAGGGGSGGGGSGGGGASAMADLEQKVLEMEASTYDGVFIWKISDFPRKRQEAVAGRIPAIFS
PAFYTSRYGYKMCLRIYLNGDGTGRGTHLSLFFVVMKGPNDALLRWPFNQKVTLMLLDQNNREHVIDAFRPDVTSS
SFQRPVNDMNIASGCPLFCPVSKMEAKNSYVRDDAIFIKAIVDLTGLGSAGSAAGSGEFGSAEAAAKEAAAKAGSAG
SAAGSGEFGSASIKLQSSDGEIFEVDVEIAKQSVTIKTMLEDLGMDDEGDDDPVPLPNVNAAILKKVIQWCTHHKDDP
PPPEDDENKEKRTDDIPVWDQEFLKVDQGTLFELILAANYLDIKGLLDVTCKTVANMIKGKTPEEIRKTFNIKNDFTEE
EEAQVRKENQWC

Isopentenyl-Diphosphate Delta-Isomerase – Enzyme Linker – cTPR6 Spacer – ID Linker – ID12

MTADNNSMPHGAVSSYAKLVQNQTPEDILEEFPEIIPLQQRPNTRSSETSNDESGETCFSGHDEEQIKLMNENCIVL
DWDDNAIGAGTKKVCHLMENIEKGLLHRAFSVFIFNEQGELLLQQRATEKITFPDLWTNTCCSHPLCIDDELGLKGKL
DDKIKGAITAAVRKLDHELGIPEDETKTRGKFHFLNRIHYMAPSNEPWGEHEIDYILFYKINAKENLTVNPNVNEVRDF
KWVSPNDLKTMFADPSYKFTPWFKIICENYLFNWWEQLDDLSEVENDRQIHRMLKLSGGGGSGGGGSGGGGSAE
AWYNLGNAYYKQGDYQKAIEYYQKALELDPNNAEAWYNLGNAYYKQGDYQKAIEYYQKALELDPNNAEAWYNLGN
AYYKQGDYQKAIEDYQKALELDPNNLQAEAWKNLGNAYYKQGDYQKAIEYYQKALELDPNNASAWYNLGNAYYKQ
GDYQKAIEYYQKALELDPNNAKAWYRRGNAYYKQGDYQKAIEDYQKALELDPNNRSRSAGGGGSGGGGSGGGGA
SSYYHHHHHHLESTSLYKKAGSGSNTVKELKNYIQELEERNAELKNLKEHLKFAKAELEFELAAHKFEGSAGSAAGS
GEFGSAEAAAKEAAAKAGSAGSAAGSGEFGSSYYHHHHHHLESTSLYKKAGSGSQKVAQLKNRVAYKLKENAKLE
NIVARLENDNANLEKDIANLEKDIANLERDVAR

Figure 6B (continued)

<u>Geranyl-Diphosphate Synthase (ERG20$^{WW}$) – Enzyme Linker – cTPR6 Spacer – ID Linker – ID13</u>

MEAKIDELINNDPVWSSQNESLISKPYNHILLKPGKNFRLNLIVQINRVMNLPKDQLAIVSQIVELLHNSSLLIDDIEDNA
PLRRGQTTSHLIWGVPSTINTANYMYFRAMQLVSQLTTKEPLYHWLITIFNEELINLHRGQGLDIYWRDFLPEIIPTQE
MYLNMVMNKTGGLFRLTLRLMEALSPSSHHGHSLVPFINLLGIIYQIRDDYLNLKDFQMSSEKGFAEDITEGKLSFPIV
HALNFTKTKGQTEQHNEILRILLLRTSDKDIKLKLIQILEFDTNSLAYTKNFINQLVNMIKNDNENKYLPDLASHSDTATN
LHDELLYIIDHLSELKLSGGGGSGGGGSGGGGSAEAWYNLGNAYYKQGDYQKAIEYYQKALELDPNNAEAWYNLG
NAYYKQGDYQKAIEYYQKALELDPNNAEAWYNLGNAYYKQGDYQKAIEDYQKALELDPNNLQAEAWKNLGNAYYK
QGDYQKAIEYYQKALELDPNNASAWYNLGNAYYKQGDYQKAIEYYQKALELDPNNAKAWYRRGNAYYKQGDYQK
AIEDYQKALELDPNNRSRSAGGGGSGGGGSGGGGASLCTMKKGPSGYGFNLHSDKSKPGQFIRSVDPDSPAEAS
GLRAQDRIVEVNGVCMEGKQHGDVVSAIRAGGDETKLLVVDREGSAGSAAGSGEFGSAEAAAKEAAAKAGSAGSA
AGSGEFGSSSGAIIYTVELKRYGGPLGITISGTEEPFDPIIISSLTKGGLAERTGAIHIGDRILAINSSSLKGKPLSEAIHLL
QMAGETVTLKIKKQTDAQPASS

<u>Olivetol Synthase – Enzyme Linker – cTPR6 Spacer – ID Linker – ID14</u>

MNHLRAEGPASVLAIGTANPENILLQDEFPDYYFRVTKSEHMTQLKEKFRKICDKSMIRKRNCFLNEEHLKQNPRLVE
HEMQTLDARQDMLVVEVPKLGKDACAKAIKEWGQPKSKITHLIFTSASTTDMPGADYHCAKLLGLSPSVKRVMMYQ
LGCYGGGTVLRIAKDIAENNKGARVLAVCCDIMACLFRGPSESDLELLVGQAIFGDGAAAVIVGAEPDESVGERPIFE
LVSTGQTILPNSEGTIGGHIREAGLIFDLHKDVPMLISNNIEKCLIEAFTPIGISDWNSIFWITHPGGKAILDKVEEKLHLK
SDKFVDSRHVLSEHGNMSSSTVLFVMDELRKRSLEEGKSTTGDGFEWGVLFGFGPGLTVERVVVRSVPIKYKLSGG
GGSGGGGSGGGGSAEAWYNLGNAYYKQGDYQKAIEYYQKALELDPNNAEAWYNLGNAYYKQGDYQKAIEYYQKA
LELDPNNAEAWYNLGNAYYKQGDYQKAIEDYQKALELDPNNLQAEAWKNLGNAYYKQGDYQKAIEYYQKALELDP
NNASAWYNLGNAYYKQGDYQKAIEYYQKALELDPNNAKAWYRRGNAYYKQGDYQKAIEDYQKALELDPNNRSRSA
GGGGSGGGGSGGGGASGNNLETYEWYNKSISRDKAEKLLLDTGKEGAFMVRDSRTPGTYTVSVFTKAIISENPCIK
HYHIKETNDSPKRYYVAEKYVFDSIPLLIQYHQYNGGGLVTRLRYPVCGGSAGSAAGSGEFGSAEAAAKEAAAKAG
SAGSAAGSGEFGSGSHPWFFGKIPRAKAEEMLSKQRHDGAFLIRESESAPGDFSLSVKFGNDVQHFKVLRDGAGK
YFLWVVKFNSLNELVDYHRSTSVSRNQQIFLRDIEQVPQQPT

<u>Olivetolic Acid Cyclase – Enzyme Linker – cTPR6 Spacer – ID Linker – ID15</u>

MAVKHLIVLKFKDEITEAQKEEFFKTYVNLVNIIPAMKDVYWGKDVTQKNKEEGYTHIVEVTFESVETIQDYIIHPAHVG
FGDVYRSFWEKLLIFDYTPRKKLSGGGGSGGGGSGGGGSAEAWYNLGNAYYKQGDYQKAIEYYQKALELDPNNA
EAWYNLGNAYYKQGDYQKAIEYYQKALELDPNNAEAWYNLGNAYYKQGDYQKAIEDYQKALELDPNNLQAEAWKN
LGNAYYKQGDYQKAIEYYQKALELDPNNASAWYNLGNAYYKQGDYQKAIEYYQKALELDPNNAKAWYRRGNAYYK
QGDYQKAIEDYQKALELDPNNRSRSAGGGGSGGGGSGGGGASGQDRSEATLIKRFKGEGVRYKAKLIGIDEVSAA
RGDKLCQDSMMKLKGVVAGARSKGEHKQKIFLTISFGGIKIFDEKTGALQHHHAVHEISYIAKDITDHRAFGYVCGKE
GNHRFVAIKTAQAAEPVILDLRDLFQLIYELKQREELEKKAGSAGSAAGSGEFGSAEAAAKEAAAKAGSAGSAAGSG
EFGSGSHMGSQFWVTSQKTEASERCGLQGSYILRVEAEKLTLLTLGAQSQILEPLLFWPYTLLRRYGRDKVMFSFE
AGRRCPSGPGTFTFQTSQGNDIFQAVEAAIQQQKAQGKVGQAQDILRLEHHHHHH

Figure 6B (continued)

<u>CBGA Synthase – Enzyme Linker – cTPR6 Spacer – ID Linker – ID16</u>

MGLSSVCTFSFQTNYHTLLNPHNNNPKTSLLCYRHPKTPIKYSYNNFPSKHCSTKSFHLQNKCSESLSIAKNSIRAAT
TNQTEPPESDNHSVATKILNFGKACWKLQRPYTIIAFTSCACGLFGKELLHNTNLISWSLMFKAFFFLVAILCIASFTTTI
NQIYDLHIDRINKPDLPLASGEISVNTAWIMSIIVALFGLIITIKMKGGPLYIFGYCFGIFGGIVYSVPPFRWKQNPSTAFL
LNFLAHIITNFTFYYASRAALGLPFELRPSFTFLLAFMKSMGSALALIKDASDVEGDTKFGISTLASKYGSRNLTLFCSG
IVLLSYVAAILAGIIWPQAFNSNVMLLSHAILAFWLILQTRDFALTNYDPEAGRRFYEFMWKLYYAEYLVYVFIKLSGGG
GSGGGGSGGGGSAEAWYNLGNAYYKQGDYQKAIEYYQKALELDPNNAEAWYNLGNAYYKQGDYQKAIEYYQKAL
ELDPNNAEAWYNLGNAYYKQGDYQKAIEDYQKALELDPNNLQAEAWKNLGNAYYKQGDYQKAIEYYQKALELDPN
NASAWYNLGNAYYKQGDYQKAIEYYQKALELDPNNAKAWYRRGNAYYKQGDYQKAIEDYQKALELDPNNRSRSAG
GGGSGGGGSGGGGASAEYVRALFDFNGNDEEDLPFKKGDILRIRDKPEEQWWNAEDSEGKRGMIPVPYVEKYGS
AGSAAGSGEFGSAEAAAKEAAAKAGSAGSAAGSGEFGSLIKHMRAEALFDFTGNSKLELNFKAGDVIFLLSRINKDW
LEGTVRGATGIFPLSFVKILK

<u>Acetyl-CoA Carboxylase – Enzyme Linker – cTPR6 Spacer – ID Linker – ID17</u>

MSEESLFESSPQKMEYEITNYSERHTELPGHFIGLNTVDKLEESPLRDFVKSHGGHTVISKILIANNGIAAVKEIRSVRK
WAYETFGDDRTVQFVAMATPEDLEANAEYIRMADQYIEVPGGTNNNNYANVDLIVDIAERADVDAVWAGWGHASE
NPLLPEKLSQSKRKVIFIGPPGNAMRSLGDKISSTIVAQSAKVPCIPWSGTGVDTVHVDEKTGLVSVDDDIYQKGCCT
SPEDGLQKAKRIGFPVMIKASEGGGGKGIRQVEREEDFIALYHQAANEIPGSPIFIMKLAGRARHLEVQLLADQYGTNI
SLFGRDCSVQRRHQKIIEEAPVTIAKAETFHEMEKAAVRLGKLVGYVSAGTVEYLYSHDDGKFYFLELNPRLQVEHP
TTEMVSGVNLPAAQLQIAMGIPMHRISDIRTLYGMNPHSASEIDFEFKTQDATKKQRRPIPKGHCTACRITSEDPNDG
FKPSGGTLHELNFRSSSNVWGYFSVGNNGNIHSFSDSQFGHIFAFGENRQASRKHMVVALKELSIRGDFRTTVEYLI
KLLETEDFEDNTITTGWLDDLITHKMTAEKPDPTLAVICGAATKAFLASEEARHKYIESLQKGQVLSKDLLQTMFPVDF
IHEGKRYKFTVAKSGNDRYTLFINGSKCDIILRQLSDGGLLIAIGGKSHTIYWKEEVAATRLSVDSMTTLLEVENDPTQL
RTPSPGKLVKFLVENGEHIIKGQPYAEIEVMKMQMPLVSQENGIVQLLKQPGSTIVAGDIMAIMTLDDPSKVKHALPFE
GMLPDFGSPVIEGTKPAYKFKSLVSTLENILKGYDNQVIMNASLQQLIEVLRNPKLPYSEWKLHISALHSRLPAKLDEQ
MEELVARSLRRGAVFPARQLSKLIDMAVKNPEYNPDKLLGAVVEPLADIAHKYSNGLEAHEHSIFVHFLEEYYEVEKL
FNGPNVREENIILKLRDENPKDLDKVALTVLSHSKVSAKNNLILAILKHYQPLCKLSSKVSAIFSTPLQHIVELESKATAK
VALQAREILIQGALPSVKERTEQIEHILKSSVVKVAYGSSNPKRSEPDLNILKDLIDSNYVVFDVLLQFLTHQDPVVTAA
AAQVYIRRAYRAYTIGDIRVHEGVTVPIVEWKFQLPSAAFSTFPTVKSKMGMNRAVSVSDLSYVANSQSSPLREGILM
AVDHLDDVDEILSQSLEVIPRHQSSSNGPAPDRSGSSASLSNVANVCVASTEGFESEEEILVRLREILDLNKQELINAS
IRRITFMFGFKDGSYPKYYTFNGPNYNENETIRHIEPALAFQLELGRLSNFNIKPIFTDNRNIHVYEAVSKTSPLDKRFF
TRGIIRTGHIRDDISIQEYLTSEANRLMSDILDNLEVTDTSNSDLNHIFINFIAVFDISPEDVEAAFGGFLERFGKRLLRLR
VSSAEIRIIIKDPQTGAPVPLRALINNVSGYVIKTEMYTEVKNAKGEWWFKSLGKPGSMHLRPIATPYPVKEWLQPKRY
KAHLMGTTYVYDFPELFRQASSSQWKNFSADVKLTDDFFISNELIEDENGELTEVEREPGANAIGMVAFKITVKTPEY
PRGRQFVVVANDITFKIGSFGPQEDEFFNKVTEYARKRGIPRIYLAANSGARIGMAEEIVPLFQVAWNDAANPDKGF
QYLYLTSEGMETLKKFDKENSVLTERTVINGEERFVIKTIIGSEDGLGVECLRGSGLIAGATSRAYHDIFTITLVTCRSV
GIGAYLVRLGQRAIQVEGQPIILTGAPAINKMLGREVYTSNLQLGGTQIMYNNGVSHLTAVDDLAGVEKIVEWMSYVP
AKRNMPVPILETKDTWDRPVDFTPTNDETYDVRWMIEGRETESGFEYGLFDKGSFFETLSGWAKGVVVGRARLGGI
PLGVIGVETRTVENLIPADPANPNSAETLIQEPGQVWHPNSAFKTAQAINDFNNGEQLPMMILANWRGFSGGQRDM
FNEVLKYGSFIVDALVDYKQPIIIYIPPTGELRGGSWVVVDPTINADQMEMYADVNARAGVLEPQGMVGIKFRREKLL
DTMNRLDDKYRELRSQLSNKSLAPEVHQQISKQLADRERELLPIYGQISLQFADLHDRSSRMVAKGVISKELEWTEA
RRFFFWRLRRRLNEEYLIKRLSHQVGEASRLEKIARIRSWYPASVDHEDDRQVATWEENYKTLDDKLKGLKLESFA
QDLAKKIRSDHDNAIDGLSEVIKMLSTDDKEKLLKTLKKLSGGGGSGGGGSGGGGSAEAWYNLGNAYYKQGDYQK
AIEYYQKALELDPNNAEAWYNLGNAYYKQGDYQKAIEYYQKALELDPNNAEAWYNLGNAYYKQGDYQKAIEDYQKA
LELDPNNLQAEAWKNLGNAYYKQGDYQKAIEYYQKALELDPNNASAWYNLGNAYYKQGDYQKAIEYYQKALELDP
NNAKAWYRRGNAYYKQGDYQKAIEDYQKALELDPNNRSRSAGGGGSGGGGSGGGGASGSHMRLGAQSIQPTAN
LDRTDDLVYLNVMELVRAVLELKNELAQLPPEGYVVVVKNVGLTLRKLIGSVDDLLPSLPSSSRTEIEGTQKLLNKDLA
ELINKMRLAQQNAVTSLSEECKRQMLTASHTLAVDAKNLLDAVDQAKVLANLAHPPAEGSAGSAAGSGEFGSAEAA
AKEAAAKAGSAGSAAGSGEFGSGAMATPGSENVLPREPLIATAVKFLQNSRVRQSPLATRRAFLKKKGLTDEEIDM
AFQQSGTAADEPSSLW

Figure 6C

Cannabinoidergic Metabolon Scaffold – (Myc)$_3$

MGSAGSAAGSGEFGSAGSAAGSGEFGSAGSAAGSGEFSYYHHHHHHLESTSLYKKAGSGSARNAYLRKKIA
RLKKDNLQLERDEQNLEKIIANLRDEIARLENEVASHEQGSAGSAAGSGEFAEAAAKEAAAKAGSAGSAAGSG
EFSYYHHHHHHLESTSLYKKAGSGSNLVAQLENEVASLENENETLKKKNLHKKDLIAYLEKEIANLRKKIEEGSA
GSAAGSGEFGSAEAAAKEAAAKEAAAKEAAAKAGSAGSAAGSGEFGSSYYHHHHHHLESTSLYKKAGSGSQ
KVAELKNRVAVKLNRNEQLKNKVEELKNRNAYLKNELATLENEVARLENDVAEGSAGSAAGSGEFAEAAAKEA
AAKAGSAGSAAGSGEFSYYHHHHHHLESTSLYKKAGSGSNEVTTLENDAAFIENENAYLEKEIARLRKEKAALR
NRLAHKKGSAGSAAGSGEFGSAEAAAKEAAAKEAAAKEAAAKAGSAGSAAGSGEFGSRPPTISNPPPLISSAK
HPSVGSAGSAAGSGEFAEAAAKEAAAKAGSAGSAAGSGEFNFLQSRPEPTAPPEESFRSGGSAGSAAGSGE
FGSAEAAAKEAAAKEAAAKAGSAGSAAGSGEFGSSKGTGLNPNAKVWQEIAPGNGSAGSAAGSGEF
AEAAAKEAAAKAGSAGSAAGSGEFPDGGTTFEHLWSSLEPDSTYGSAGSAAGSGEFGSAEAAAKEAAAKEA
AAKEAAAKAGSAGSAAGSGEFGSSYYHHHHHHLESTSLYKKAGSGSKRIAYLRKKIAALKKDNANLEKDIANLE
NEIERLIKEIKTLENEVASHEQGSAGSAAGSGEFAEAAAKEAAAKAGSAGSAAGSGEFSYYHHHHHHLESTSLY
KKAGSGSNLLATLRSTAAVLENENHVLEKEKEKLRKEKEQLLNKLEAYKGSAGSAAGSGEFGSAEAAAKEAAA
KEAAAKEAAAKAGSAGSAAGSGEFGSPATSQHPPPPPGHRSQAPSHGSAGSAAGSGEFAEAAAKEAAAKAG
SAGSAAGSGEFELNSLLILLEAAEYLERRDRGSAGSAAGSGEFGSAEAAAKEAAAKEAAAKEAAAKAGSAGSA
AGSGEFGSRPPTISNPPPLISSAKHPSVGSAGSAAGSGEFAEAAAKEAAAKAGSAGSAAGSGEFNFLQSRPEP
TAPPEESFRSGGSAGSAAGSGEFGSAEAAAKEAAAKEAAAKEAAAKAGSAGSAAGSGEFGSSKGTGLNPNA
KVWQEIAPGNGSAGSAAGSGEFAEAAAKEAAAKAGSAGSAAGSGEFPDGGTTFEHLWSSLEPDSTYGSAGS
AAGSGEFGSAEAAAKEAAAKEAAAKEAAAKAGSAGSAAGSGEFGSSYYHHHHHHLESTSLYKKAGSGSKRIA
YLRKKIAALKKDNANLEKDIANLENEIERLIKEIKTLENEVASHEQGSAGSAAGSGEFAEAAAKEAAAKAGSAGS
AAGSGEFSYYHHHHHHLESTSLYKKAGSGSNLLATLRSTAAVLENENHVLEKEKEKLRKEKEQLLNKLEAYKG
SAGSAAGSGEFGSAEAAAKEAAAKEAAAKEAAAKAGSAGSAAGSGEFGSALVDDAADYEPPPSNNEEALGSA
GSAAGSGEFAEAAAKEAAAKAGSAGSAAGSGEFRELFDDPSYVNVQNLDKARQGSAGSAAGSGEFGSAEAA
AKEAAAKEAAAKEAAAKAGSAGSAAGSGEFGSKNTKSMNFDNPVYRKTTEEEGSAGSAAGSGEFAEAAAKE
AAAKAGSAGSAAGSGEFRSLPSTWIENKLYGMSDPNWGSAGSAAGSGEFGSAEAAAKEAAAKEAAAKEAAA
KAGSAGSAAGSGEFGSVVDNSPPPALPPKKRQSAPSGSAGSAAGSGEFAEAAAKEAAAKAGSAGSAAGSGE
FTQRSKPQPAVPPRPSADLILGSAGSAAGSGEFGSAEAAAKEAAAKEAAAKEAAAKAGSAGSAAGSGEFGST
DEEREETEEEVYLLNSTTLGSAGSAAGSGEFAEAAAKEAAAKAGSAGSAAGSGEFDGNVSGTQRLDSATVRT
YSCGSAGSAAGSGEFGSAEAAAKEAAAKEAAAKEAAAKAGSAGSAAGSGEFGSSYYHHHHHHLESTSLYKK
AGSGSQKVAQLKNRVAYKLKENAKLENIVARLENDNANLEKDIANLEKDIANLERDVARGSAGSAAGSGEFAE
AAAKEAAAKAGSAGSAAGSGEFSYYHHHHHHLESTSLYKKAGSGSNTVKELKNYIQELEERNAELKNLKEHLK
FAKAELEFELAAHKFEGSAGSAAGSGEFGSAEAAAKEAAAKEAAAKEAAAKAGSAGSAAGSGEFGSHDDSLP
HPQQATDDSGHESDGSAGSAAGSGEFAEAAAKEAAAKAGSAGSAAGSGEFGSPNAGSVEQTPKKPGLRRR
GSAGSAAGSGEFGSAEAAAKEAAAKEAAAKEAAAKAGSAGSAAGSGEFGSSYYHHHHHHLESTSLYKKAGS
GSFENVTHEFILATLENENAKLRRLEAKLERELARLRNEVAWLGSAGSAAGSGEFAEAAAKEAAAKAGSAGSA
AGSGEFSYYHHHHHHLESTSLYKKAGSGSQKVEELKNKIAELENRNAVKKNRVAHLKQEIAYLKDELAAHEFE
GSAGSAAGSGEFGSAEAAAKEAAAKEAAAKEAAAKAGSAGSAAGSGEFGSVSSTKLVSFHDDSDEDLLHIGS
AGSAAGSGEFAEAAAKEAAAKAGSAGSAAGSGEFAAATPISTFHDDSDEDLLHVGSAGSAAGSGEFGSAEAA
AKEAAAKEAAAKAGSAGSAAGSGEFGSSYYHHHHHHLESTSLYKKAGSGSQKVESLKQKIEELKQRK
AQLKNDIANLEKEIAYAETGSAGSAAGSGEFAEAAAKEAAAKAGSAGSAAGSGEFSYYHHHHHHLESTSLYKK
AGSEFFRRERNKMAAAKCRNRRRELTDTLQAETDQLEDEKSALQTEIANLLKEKEKLEFILAAHRPACKIPDDL
GFPEEMSLEGSAGSAAGSGEFGSAEAAAKEAAAKEAAAKAGSAGSAAGSGEFGSFQMPADTPPPAY
LPPEDPMTGSAGSAAGSGEFAEAAAKEAAAKAGSAGSAAGSGEFERESNEEPPPPYEDPYWGNGGSAGSA
AGSGEFGSAEAAAKEAAAKEAAAKAGSAGSAAGSGEFGSSYYHHHHHHLESTSLYKKAGSGSQKVA
ELKNRVAVKLNRNEQLKNKVEELKNRNAYLKNELATLENEVARLENDVAEGSAGSAAGSGEFAEAAAKEAAAK

Figure 6C (continued)

AGSAGSAAGSGEFSYYHHHHHHLESTSLYKKAGSGSNEVTTLENDAAFIENENAYLEKEIARLRKEKAALRNRL
AHKKSYYHHHHHHLESTSLYKKAGSGSARNAYLRKKIARLKKDNLQLERDEQNLEKIIANLRDEIARLENEVASH
EQGSAGSAAGSGEFAEAAAKEAAAKAGSAGSAAGSGEFSYYHHHHHHLESTSLYKKAGSGSNLVAQLENEV
ASLENENETLKKKNLHKKDLIAYLEKEIANLRKKIEEGSAGSAAGSGEFGSAEAAAKEAAAKEAAAKEAAAKAG
SAGSAAGSGEFGSEQKLISEEDLEQKLISEEDLEQKLISEEDLGSAGSAAGSGEFGSAGSAAGSGEFGSAGSA
AGSGEF

Figure 6D

Malonyl-CoA Metabolon Scaffold – (FLAG)$_3$

MGSAGSAAGSGEFGSAGSAAGSGEFGSAGSAAGSGEFSYYHHHHHHLESTSLYKKAGSGSARNAYLRKKIA
RLKKDNLQLERDEQNLEKIIANLRDEIARLENEVASHEQGSAGSAAGSGEFAEAAAKEAAAKAGSAGSAAGSG
EFSYYHHHHHHLESTSLYKKAGSGSNLVAQLENEVASLENENETLKKKNLHKKDLIAYLEKEIANLRKKIEEGSA
GSAAGSGEFGSAEAAAKEAAAKEAAAKEAAAKAGSAGSAAGSGEFGSSATRELDELMASLSDFKIQGGSAGS
AAGSGEFAEAAAKEAAAKAGSAGSAAGSGEFDLALSENWAQEFLAAGDAVDGSAGSAAGSGEFGSAEAAAK
EAAAKEAAAKEAAAKAGSAGSAAGSGEFGSDYKDDDDKDYKDDDDKDYKDDDDKGSAGSAAGSGEFGSAG
SAAGSGEFGSAGSAAGSGEF

Figure 12A

ATP Citrate Lyase

```
ATGTCTGCTAAAGCTATTTCTGAACAAACTGGTAAAGAATTGTTGTATAAATTTATTTGTACTACTTCTGCTATTC
AAAATAGATTTAAATATGCTAGAGTTACTCCAGATACTGATTGGGCTAGATTGTTGCAAGATCATCCATGGTTGT
TGTCTCAAAATTTGGTTGTTAAACCAGATCAATTGATTAAAAGAAGAGGTAAATTGGGTTTGGTTGGTGTTAATTT
GACTTTGGATGGTGTTAAATCTTGGTTGAAACCAAGATTGGGTCAAGAAGCTACTGTTGGTAAAGCTACTGGTT
TTTTGAAAAATTTTTTGATTGAACCATTTGTTCCACATTCTCAAGCTGAAGAATTTTATGTTTGTATTTATGCTACT
AGAGAAGGTGATTATGTTTTGTTTCATCATGAAGGTGGTGTTGATGTTGGTGATGTTGATGCTAAAGCTCAAAAA
TTGTTGGTTGGTGTTGATGAAAAATTGAATCCAGAAGATATTAAAAAACATTTGTTGGTTCATGCTCCAGAAGAT
AAAAAAGAAATTTTGGCTTCTTTTATTTCTGGTTTGTTTAATTTTTATGAAGATTTGTATTTTACTTATTTGGAAATT
AATCCATTGGTTGTTACTAAAGATGGTGTTTATGTTTTGGATTTGGCTGCTAAAGTTGATGCTACTGCTGATTATA
TTTGTAAAGTTAAATGGGGTGATATTGAATTTCCACCACCATTTGGTAGAGAAGCTTATCCAGAAGAAGCTTATA
TTGCTGATTTGGATGCTAAATCTGGTGCTTCTTTGAAATTGACTTTGTTGAATCCAAAAGGTAGAATTTGGACTAT
GGTTGCTGGTGGTGGTGCTTCTGTTGTTTATTCTGATACTATTTGTGATTTGGGTGGTGTTAATGAATTGGCTAA
TTATGGTGAATATTCTGGTGCTCCATCTGAACAACAAACTTATGATTATGCTAAAACTATTTTGTCTTTGATGACT
AGAGAAAAACATCCAGATGGTAAAATTTTGATTATTGGTGGTTCTATTGCTAATTTTACTAATGTTGCTGCTACTT
TTAAAGGTATTGTTAGAGCTATTAGAGATTATCAAGGTCCATTGAAAGAACATGAAGTTACTATTTTTGTTAGAAG
AGGTGGTCCAAATTATCAAGAAGGTTTGAGAGTTATGGGTGAAGTTGGTAAAACTACTGGTATTCCAATTCATGT
TTTTGGTACTGAAACTCATATGACTGCTATTGTTGGTATGGCTTTGGGTCATAGACCAATTCCAAATCAACCACC
AACTGCTGCTCATACTGCTAATTTTTTGTTGAATGCTTCTGGTTCTACTTCTACTCCAGCTCCATCTAGAACTGCT
TCTTTTTCTGAATCTAGAGCTGATGAAGTTGCTCCAGCTAAAAAAGCTAAACCAGCTATGCCACAAGATTCTGTT
CCATCTCCAAGATCTTTGCAAGGTAAATCTACTACTTTGTTTTCTAGACATACTAAAGCTATTGTTTGGGGTATGC
AAACTAGAGCTGTTCAAGGTATGTTGGATTTTGATTATGTTTGTTCTAGAGATGAACCATCTGTTGCTGCTATGG
TTTATCCATTTACTGGTGATCATAAACAAAAATTTTATTGGGGTCATAAAGAAATTTTGATTCCAGTTTTTAAAAAT
ATGGCTGATGCTATGAGAAAACATCCAGAAGTTGATGTTTTGATTAATTTTGCTTCTTTGAGATCTGCTTATGATT
CTACTATGGAAACTATGAATTATGCTCAAATTAGAACTATTGCTATTATTGCTGAAGGTATTCCAGAAGCTTTGAC
TAGAAAATTGATTAAAAAAGCTGATCAAAAAGGTGTTACTATTATTGGTCCAGCTACTGTTGGTGGTATTAAACC
AGGTTGTTTTAAAATTGGTAATACTGGTGGTATGTTGGATAATATTTTGGCTTCTAAATTGTATAGACCAGGTTCT
GTTGCTTATGTTTCTAGATCTGGTGGTATGTCTAATGAATTGAATAATATTATTTCTAGAACTACTGATGGTGTTT
ATGAAGGTGTTGCTATTGGTGGTGATAGATATCCAGGTTCTACTTTTATGGATCATGTTTTGAGATATCAAGATA
CTCCAGGTGTTAAAATGATTGTTGTTTTGGGTGAAATTGGTGGTACTGAAGAATATAAAATTTGTAGAGGTATTA
AAGAAGGTAGATTGACTAAACCAATTGTTTGTTGGTGTATTGGTACTTGTGCTACTATGTTTTCTTCTGAAGTTCA
ATTTGGTCATGCTGGTGCTTGTGCTAATCAAGCTTCTGAAACTGCTGTTGCTAAAAATCAAGCTTTGAAAGAAGC
TGGTGTTTTTGTTCCAAGATCTTTTGATGAATTGGGTGAAATTATTCAATCTGTTTATGAAGATTTGGTTGCTAAT
GGTGTTATTGTTCCAGCTCAAGAAGTTCCACCACCAACTGTTCCAATGGATTATTCTTGGGCTAGAGAATTGGG
TTTGATTAGAAAACCAGCTTCTTTTATGACTTCTATTTGTGATGAAAGAGGTCAAGAATTGATTTATGCTGGTATG
CCAATTACTGAAGTTTTTAAAGAAGAAATGGGTATTGGTGGTGTTTTGGGTTTGTTGTGGTTTCAAAAAAGATTG
CCAAAATATTCTTGTCAATTTATTGAAATGTGTTTGATGGTTACTGCTGATCATGGTCCAGCTGTTTCTGGTGCT
CATAATACTATTATTTGTGCTAGAGCTGGTAAAGATTTGGTTTCTTCTTTGACTTCTGGTTTGTTGACTATTGGTG
ATAGATTTGGTGGTGCTTTGGATGCTGCTGCTAAAATGTTTTCTAAAGCTTTTGATTCTGGTATTATTCCAATGGA
ATTTGTTAATAAAATGAAAAAAGAAGGTAAATTGATTATGGGTATTGGTCATAGAGTTAAATCTATTAATAATCCA
GATATGAGAGTTCAAATTTTGAAAGATTATGTTAGACAACATTTTCCAGCTACTCCATTGTTGGATTATGCTTTGG
AAGTTGAAAAAATTACTACTTCTAAAAAACCAAATTTGATTTTGAATGTTGATGGTTTGATTGGTGTTGCTTTTGTT
GATATGTTGAGAAATTGTGGTTCTTTTACTAGAGAAGAAGCTGATGAATATATTGATATTGGTGCTTTGAATGGT
ATTTTTGTTTGGGTAGATCTATGGGTTTTATTGGTCATTATTTGGATCAAAAAGATTGAAACAAGGTTTGTATA
GACATCCATGGGATGATATTTCTTATGTTTTGCCAGAACATATGTCTATG
```

Figure 12A (continued)

Acetyl-CoA Acetyltransferase (atoB)

ATGAAAAATTGTGTTATTGTTTCTGCTGTTAGAACTGCTATTGGTTCTTTTAATGGTTCTTTGGCTTCTACTTCTG
CTATTGATTTGGGTGCTACTGTTATTAAAGCTGCTATTGAAAGAGCTAAAATTGATTCTCAACATGTTGATGAAGT
TATTATGGGTAATGTTTTGCAAGCTGGTTTGGGTCAAAATCCAGCTAGACAAGCTTTGTTGAAATCTGGTTTGGC
TGAAACTGTTTGTGGTTTTACTGTTAATAAAGTTTGTGGTTCTGGTTTGAAATCTGTTGCTTTGGCTGCTCAAGCT
ATTCAAGCTGGTCAAGCTCAATCTATTGTTGCTGGTGGTATGGAAAATATGTCTTTGGCTCCATATTTGTTGGAT
GCTAAAGCTAGATCTGGTTATAGATTGGGTGATGGTCAAGTTTATGATGTTATTTTGAGAGATGGTTTGATGTGT
GCTACTCATGGTTATCATATGGGTATTACTGCTGAAAATGTTGCTAAAGAATATGGTATTACTAGAGAAATGCAA
GATGAATTGGCTTTGCATTCTCAAAGAAAAGCTGCTGCTGCTATTGAATCTGGTGCTTTTACTGCTGAAATTGTT
CCAGTTAATGTTGTTACTAGAAAAAAAACTTTTGTTTTTTCTCAAGATGAATTTCCAAAAGCTAATTCTACTGCTG
AAGCTTTGGGTGCTTTGAGACCAGCTTTTGATAAAGCTGGTACTGTTACTGCTGGTAATGCTTCTGGTATTAATG
ATGGTGCTGCTGCTTTGGTTATTATGGAAGAATCTGCTGCTTTGGCTGCTGGTTTGACTCCATTGGCTAGAATTA
AATCTTATGCTTCTGGTGGTGTTCCACCAGCTTTGATGGGTATGGGTCCAGTTCCAGCTACTCAAAAAGCTTTG
CAATTGGCTGGTTTGCAATTGGCTGATATTGATTTGATTGAAGCTAATGAAGCTTTTGCTGCTCAATTTTTGGCT
GTTGGTAAAAATTTGGGTTTTGATTCTGAAAAAGTTAATGTTAATGGTGGTGCTATTGCTTTGGGTCATCCAATT
GGTGCTTCTGGTGCTAGAATTTTGGTTACTTTGTTGCATGCTATGCAAGCTAGAGATAAAACTTTGGGTTTGGCT
ACTTTGTGTATTGGTGGTGGTCAAGGTATTGCTATGGTTATTGAAAGATTGAAT

3-Hydroxybutyryl-CoA Dehydrogenase

ATGAAAAAAGTTTGTGTTATTGGTGCTGGTACTATGGGTTCTGGTATTGCTCAAGCTTTTGCTGCTAAAGGTTTT
GAAGTTGTTTTGAGAGATATTAAAGATGAATTTGTTGATAGAGGTTTGGATTTTATTAATAAAAATTTGTCTAAATT
GGTTAAAAAAGGTAAAATTGAAGAAGCTACTAAAGTTGAAATTTTGACTAGAATTTCTGGTACTGTTGATTTGAAT
ATGGCTGCTGATTGTGATTTGGTTATTGAAGCTGCTGTTGAAAGAATGGATATTAAAAAACAAATTTTTGCTGATT
TGGATAATATTTGTAAACCAGAAACTATTTTGGCTTCTAATACTTCTTCTTTGTCTATTACTGAAGTTGCTTCTGCT
ACTAAAAGACCAGATAAAGTTATTGGTATGCATTTTTTTAATCCAGCTCCAGTTATGAAATTGGTTGAAGTTATTA
GAGGTATTGCTACTTCTCAAGAAACTTTTGATGCTGTTAAAGAAACTTCTATTGCTATTGGTAAAGATCCAGTTG
AAGTTGCTGAAGCTCCAGGTTTTGTTGTTAATAGAATTTTGATTCCAATGATTAATGAAGCTGTTGGTATTTTGGC
TGAAGGTATTGCTTCTGTTGAAGATATTGATAAAGCTATGAAATTGGGTGCTAATCATCCAATGGGTCCATTGGA
ATTGGGTGATTTTATTGGTTTGGATATTTGTTTGGCTATTATGGATGTTTTGTATTCTGAAACTGGTGATTCTAAA
TATAGACCACATACTTTGTTGAAAAAATATGTTAGAGCTGGTTGGTTGGGTAGAAAATCTGGTAAAGGTTTTTAT
GATTATTCTAAA

Enoyl-CoA Hydratase

ATGGAATTGAATAATGTTATTTTGGAAAAAGAAGGTAAAGTTGCTGTTGTTACTATTAATAGACCAAAAGCTTTGA
ATGCTTTGAATTCTGATACTTTGAAAGAAATGGATTATGTTATTGGTGAAATTGAAAATGATTCTGAAGTTTTGGC
TGTTATTTTGACTGGTGCTGGTGAAAAATCTTTTGTTGCTGGTGCTGATATTTCTGAAATGAAAGAAATGAATACT
ATTGAAGGTAGAAAATTTGGTATTTTGGGTAATAAAGTTTTTAGAAGATTGGAATTGTTGGAAAAACCAGTTATTG
CTGCTGTTAATGGTTTTGCTTTGGGTGGTGGTTGTGAAATTGCTATGTCTTGTGATATTAGAATTGCTTCTTCTAA
TGCTAGATTTGGTCAACCAGAAGTTGGTTTGGGTATTACTCCAGGTTTTGGTGGTACTCAAAGATTGTCTAGATT
GGTTGGTATGGGTATGGCTAAACAATTGATTTTTACTGCTCAAAATATTAAAGCTGATGAAGCTTTGAGAATTGG
TTTGGTTAATAAAGTTGTTGAACCATCTGAATTGATGAATACTGCTAAAGAAATTGCTAATAAAATTGTTTCTAAT
GCTCCAGTTGCTGTTAAATTGTCTAAACAAGCTATTAATAGAGGTATGCAATGTGATATTGATACTGCTTTGGCT
TTTGAATCTGAAGCTTTTGGTGAATGTTTTCTACTGAAGATCAAAAAGATGCTATGACTGCTTTTATTGAAAAAA
GAAAAATTGAAGGTTTTAAAAATAGA

Figure 12A (continued)

Trans-Enoyl-CoA Reductase

ATGATTGTTAAACCAATGGTTAGAAATAATATTTGTTTGAATGCTCATCCACAAGGTTGTAAAAAAGGTGTTGAA
GATCAAATTGAATATACTAAAAAAAGAATTACTGCTGAAGTTAAAGCTGGTGCTAAAGCTCCAAAAAATGTTTTG
GTTTTGGGTTGTTCTAATGGTTATGGTTTGGCTTCTAGAATTACTGCTGCTTTTGGTTATGGTGCTGCTACTATT
GGTGTTTCTTTTGAAAAAGCTGGTTCTGAAACTAAATATGGTACTCCAGGTTGGTATAATAATTTGGCTTTTGAT
GAAGCTGCTAAAAGAGAAGGTTTGTATTCTGTTACTATTGATGGTGATGCTTTTTCTGATGAAATTAAAGCTCAA
GTTATTGAAGAAGCTAAAAAAAAAGGTATTAAATTTGATTTGATTGTTTATTCTTTGGCTTCTCCAGTTAGAACTG
ATCCAGATACTGGTATTATGCATAAATCTGTTTTGAAACCATTTGGTAAAACTTTTACTGGTAAAACTGTTGATCC
ATTTACTGGTGAATTGAAAGAAATTTCTGCTGAACCAGCTAATGATGAAGAAGCTGCTGCTACTGTTAAAGTTAT
GGGTGGTGAAGATTGGGAAAGATGGATTAAACAATTGTCTAAAGAAGGTTTGTTGGAAGAAGGTTGTATTACTT
TGGCTTATTCTTATATTGGTCCAGAAGCTACTCAAGCTTTGTATAGAAAAGGTACTATTGGTAAAGCTAAAGAAC
ATTTGGAAGCTACTGCTCATAGATTGAATAAAGAAAATCCATCTATTAGAGCTTTTGTTTCTGTTAATAAAGGTTT
GGTTACTAGAGCTTCTGCTGTTATTCCAGTTATTCCATTGTATTTGGCTTCTTTGTTTAAAGTTATGAAAGAAAAA
GGTAATCATGAAGGTTGTATTGAACAAATTACTAGATTGTATGCTGAAAGATTGTATAGAAAAGATGGTACTATT
CCAGTTGATGAAGAAAATAGAATTAGAATTGATGATTGGGAATTGGAAGAAGATGTTCAAAAAGCTGTTTCTGCT
TTGATGGAAAAAGTTACTGGTGAAAATGCTGAATCTTTGACTGATTTGGCTGGTTATAGACATGATTTTTTGGCT
TCTAATGGTTTTGATGTTGAAGGTATTAATTATGAAGCTGAAGTTGAAAGATTTGATAGAATT

Beta-Ketothiolase (bktB)

ATGACTAGAGAAGTTGTTGTTGTTTCTGGTGTTAGAACTGCTATTGGTACTTTTGGTGGTTCTTTGAAAGATGTT
GCTCCAGCTGAATTGGGTGCTTTGGTTGTTAGAGAAGCTTTGGCTAGAGCTCAAGTTTCTGGTGATGATGTTGG
TCATGTTGTTTTTGGTAATGTTATTCAAACTGAACCAAGAGATATGTATTTGGGTAGAGTTGCTGCTGTTAATGG
TGGTGTTACTATTAATGCTCCAGCTTTGACTGTTAATAGATTGTGTGGTTCTGGTTTGCAAGCTATTGTTTCTGCT
GCTCAAACTATTTTGTTGGGTGATACTGATGTTGCTATTGGTGGTGGTGCTGAATCTATGTCTAGAGCTCCATAT
TTGGCTCCAGCTGCTAGATGGGGTGCTAGAATGGGTGATGCTGGTTTGATATGATGTTGGGTGCTTTGC
ATGATCCATTTCATAGAATTCATATGGGTGTTACTGCTGAAAATGTTGCTAAAGAATATGATATTTCTAGAGCTCA
ACAAGATGAAGCTGCTTTGGAATCTCATAGAAGAGCTTCTGCTGCTATTAAAGCTGGTTATTTTAAAGATCAAAT
TGTTCCAGTTGTTTCTAAAGGTAGAAAAGGTGATGTTACTTTTGATACTGATGAACATGTTAGACATGATGCTAC
TATTGATGATATGACTAAATTGAGACCAGTTTTTGTTAAAGAAAATGGTACTGTTACTGCTGGTAATGCTTCTGGT
TTGAATGATGCTGCTGCTGCTGTTGTTATGATGGAAAGAGCTGAAGCTGAAAGAAGAGGTTTGAAACCATTGGC
TAGATTGGTTTCTTATGGTCATGCTGGTGTTGATCCAAAAGCTATGGGTATTGGTCCAGTTCCAGCTACTAAAAT
TGCTTTGGAAAGAGCTGGTTTGCAAGTTTCTGATTTGGATGTTATTGAAGCTAATGAAGCTTTTGCTGCTCAAGC
TTGTGCTGTTACTAAAGCTTTGGGTTTGGATCCAGCTAAAGTTAATCCAAATGGTTCTGGTATTTCTTTGGGTCA
TCCAATTGGTGCTACTGGTGCTTTGATTACTGTTAAAGCTTTGCATGAATTGAATAGAGTTCAAGGTAGATATGC
TTTGGTTACTATGTGTATTGGTGGTGGTCAAGGTATTGCTGCTATTTTTGAAAGAATT

Figure 12A (continued)

HMG CoA Synthase

ATGAAACTCTCAACTAAACTTTGTTGGTGTGGTATTAAAGGAAGACTTAGGCCGCAAAAGCAACAACAATTACAC
AATACAAACTTGCAAATGACTGAACTAAAAAAACAAAAGACCGCTGAACAAAAAACCAGACCTCAAAATGTCGGT
ATTAAAGGTATCCAAATTTACATCCCAACTCAATGTGTCAACCAATCTGAGCTAGAGAAATTTGATGGCGTTTCT
CAAGGTAAATACACAATTGGTCTGGGCCAAACCAACATGTCTTTTGTCAATGACAGAGAAGATATCTACTCGAT
GTCCCTAACTGTTTTGTCTAAGTTGATCAAGAGTTACAACATCGACACCAACAAAATTGGTAGATTAGAAGTCGG
TACTGAAACTCTGATTGACAAGTCCAAGTCTGTCAAGTCTGTCTTGATGCAATTGTTTGGTGAAAACACTGACGT
CGAAGGTATTGACACGCTTAATGCCTGTTACGGTGGTACCAACGCGTTGTTCAACTCTTTGAACTGGATTGAAT
CTAACGCATGGGATGGTAGAGACGCCATTGTAGTTTGCGGTGATATTGCCATCTACGATAAGGGTGCCGCAAG
ACCAACCGGTGGTGCCGGTACTGTTGCTATGTGGATCGGTCCTGATGCTCCAATTGTATTTGACTCTGTAAGAG
CTTCTTACATGGAACACGCCTACGATTTTTACAAGCCAGATTTCACCAGCGAATATCCTTACGTCGATGGTCATT
TTTCATTAACTTGTTACGTCAAGGCTCTTGATCAAGTTTACAAGAGTTATTCCAAGAAGGCTATTTCTAAAGGGTT
GGTTAGCGATCCCGCTGGTTCGGATGCTTTGAACGTTTTGAAATATTTCGACTACAACGTTTTCCATGTTCCAAC
CTGTAAATTGGTCACAAAATCATACGGTAGATTACTATATAACGATTTCAGAGCCAATCCTCAATTGTTCCCAGA
AGTTGACGCCGAATTAGCTACTCGCGATTATGACGAATCTTTAACCGATAAGAACATTGAAAAAACTTTTGTTAA
TGTTGCTAAGCCATTCCACAAAGAGAGAGTTGCCCAATCTTTGATTGTTCCAACAAACACAGGTAACATGTACAC
CGCATCTGTTTATGCCGCCTTTGCATCTCTATTAAACTATGTTGGATCTGACGACTTACAAGGCAAGCGTGTTG
GTTTATTTTCTTACGGTTCCGGTTTAGCTGCATCTCTATATTCTTGCAAAATTGTTGGTGACGTCCAACATATTAT
CAAGGAATTAGATATTACTAACAAATTAGCCAAGAGAATCACCGAAACTCCAAAGGATTACGAAGCTGCCATCG
AATTGAGAGAAAATGCCCATTTGAAGAAGAACTTCAAACCTCAAGGTTCCATTGAGCATTTGCAAAGTGGTGTTT
ACTACTTGACCAACATCGATGACAAATTTAGAAGATCTTACGATGTTAAAAAATAA

Truncated HMG-CoA Reductase

ATGGTTGCGGTACGTAGGAAGGCTCTTTCAATTTTGGCAGAAGCTCCTGTATTAGCATCTGATCGTTTACCATAT
AAAAATTATGACTACGACCGCGTATTTGGCGCTTGTTGTGAAAATGTTATAGGTTACATGCCTTTGCCCGTTGGT
GTTATAGGCCCCTTGGTTATCGATGGTACATCTTATCATATACCAATGGCAACTACAGAGGGTTGTTTGGTAGCT
TCTGCCATGCGTGGCTGTAAGGCAATCAATGCTGGCGGTGGTGCAACAACTGTTTTAACTAAGGATGGTATGA
CAAGAGGCCCAGTAGTCCGTTTCCCAACTTTGAAAAGATCTGGTGCCTGTAAGATATGGTTAGACTCAGAAGAG
GGACAAAACGCAATTAAAAAAGCTTTTAACTCTACATCAAGATTTGCACGTCTGCAACATATTCAAACTTGTCTA
GCAGGAGATTTACTCTTCATGAGATTTAGAACAACTACTGGTGACGCAATGGGTATGAATATGATTTCTAAAGGT
GTCGAATACTCATTAAAGCAAATGGTAGAAGAGTATGGCTGGGAAGATATGGAGGTTGTCTCCGTTTCTGGTAA
CTACTGTACCGACAAAAAACCAGCTGCCATCAACTGGATCGAAGGTCGTGGTAAGAGTGTCGTCGCAGAAGCT
ACTATTCCTGGTGATGTTGTCAGAAAAGTGTTAAAAAGTGATGTTTCCGCATTGGTTGAGTTGAACATTGCTAAG
AATTTGGTTGGATCTGCAATGGCTGGGTCTGTTGGTGGATTTAACGCACATGCAGCTAATTTAGTGACAGCTGT
TTTCTTGGCATTAGGACAAGATCCTGCACAAAATGTTGAAAGTTCCAACTGTATAACATTGATGAAAGAAGTGGA
CGGTGATTTGAGAATTTCCGTATCCATGCCATCCATCGAAGTAGGTACCATCGGTGGTGGTACTGTTCTAGAAC
CACAAGGTGCCATGTTGGACTTATTAGGTGTAAGAGGCCCGCATGCTACCGCTCCTGGTACCAACGCACGTCA
ATTAGCAAGAATAGTTGCCTGTGCCGTCTTGGCAGGTGAATTATCCTTATGTGCTGCCCTAGCAGCCGGCCATT
TGGTTCAAAGTCATATGACCCACAACAGG

Figure 12A (continued)

Mevalonate Kinase

ATGTCATTACCGTTCTTAACTTCTGCACCGGGAAAGGTTATTATTTTTGGTGAACACTCTGCTGTGTACAACAAG
CCTGCCGTCGCTGCTAGTGTGTCTGCGTTGAGAACCTACCTGCTAATAAGCGAGTCATCTGCACCAGATACTAT
TGAATTGGACTTCCCGGACATTAGCTTTAATCATAAGTGGTCCATCAATGATTTCAATGCCATCACCGAGGATCA
AGTAAACTCCCAAAAATTGGCCAAGGCTCAACAAGCCACCGATGGCTTGTCTCAGGAACTCGTTAGTCTTTTGG
ATCCGTTGTTAGCTCAACTATCCGAATCCTTCCACTACCATGCAGCGTTTTGTTTCCTGTATATGTTTGTTTGCCT
ATGCCCCCATGCCAAGAATATTAAGTTTTCTTTAAAGTCTACTTTACCCATCGGTGCTGGGTTGGGCTCAAGCG
CCTCTATTTCTGTATCACTGGCCTTAGCTATGGCCTACTTGGGGGGGTTAATAGGATCTAATGACTTGGAAAAG
CTGTCAGAAAACGATAAGCATATAGTGAATCAATGGGCCTTCATAGGTGAAAGTGTATTCACGGTACCCCTTC
AGGAATAGATAACGCTGTGGCCACTTATGGTAATGCCCTGCTATTTGAAAAAGACTCACATAATGGAACAATAAA
CACAAACAATTTTAAGTTCTTAGATGATTTCCCAGCCATTCCAATGATCCTAACCTATACTAGAATTCCAAGGTCT
ACAAAAGATCTTGTTGCTCGCGTTCGTGTGTTGGTCACCGAGAAATTTCCTGAAGTTATGAAGCCAATTCTAGAT
GCCATGGGTGAATGTGCCCTACAAGGCTTAGAGATCATGACTAAGTTAAGTAAATGTAAAGGCACCGATGACGA
GGCTGTAGAAACTAATAATGAACTGTATGAACAACTATTGGAATTGATAAGAATAAATCATGGACTGCTTGTCTC
AATCGGTGTTTCTCATCCTGGATTAGAACTTATTAAAAATCTGAGCGATGATTTGAGAATTGGCTCCACAAAACT
TACCGGTGCTGGTGGCGGCGGTTGCTCTTTGACTTTGTTACGAAGAGACATTACTCAAGAGCAAATTGACAGCT
TCAAAAAGAAATTGCAAGATGATTTTAGTTACGAGACATTTGAAACAGACTTGGGTGGGACTGGCTGCTGTTTG
TTAAGCGCAAAAAATTTGAATAAAGATCTTAAAATCAAATCCCTAGTATTCCAATTATTTGAAAATAAAACTACCA
CAAAGCAACAAATTGACGATCTATTATTGCCAGGAAACACGAATTTACCATGGACTTCATAA

Phosphomevalonate Kinase

ATGTCAGAGTTGAGAGCCTTCAGTGCCCCAGGGAAAGCGTTACTAGCTGGTGGATATTTAGTTTTAGATACAAA
ATATGAAGCATTTGTAGTCGGATTATCGGCAAGAATGCATGCTGTAGCCCATCCTTACGGTTCATTGCAAGGGT
CTGATAAGTTTGAAGTGCGTGTGAAAAGTAAACAATTTAAAGATGGGGAGTGGCTGTACCATATAAGTCCTAAA
AGTGGCTTCATTCCTGTTTCGATAGGCGGATCTAAGAACCCTTTCATTGAAAAAGTTATCGCTAACGTATTTAGC
TACTTTAAACCTAACATGGACGACTACTGCAATAGAAACTTGTTCGTTATTGATATTTTCTCTGATGATGCCTACC
ATTCTCAGGAGGATAGCGTTACCGAACATCGTGGCAACAGAAGATTGAGTTTTCATTCGCACAGAATTGAAGAA
GTTCCCAAAACAGGGCTGGGCTCCTCGGCAGGTTTAGTCACAGTTTTAACTACAGCTTTGGCCTCCTTTTTTGT
ATCGGACCTGGAAAATAATGTAGACAAATATAGAGAAGTTATTCATAATTTAGCACAAGTTGCTCATTGTCAAGC
TCAGGGTAAAATTGGAAGCGGGTTTGATGTAGCGGCGGCAGCATATGGATCTATCAGATATAGAAGATTCCCA
CCCGCATTAATCTCTAATTTGCCAGATATTGGAAGTGCTACTTACGGCAGTAAACTGGCGCATTTGGTTGATGA
AGAAGACTGGAATATTACGATTAAAAGTAACCATTTACCTTCGGGATTAACTTTATGGATGGGCGATATTAAGAA
TGGTTCAGAAACAGTAAAACTGGTCCAGAAGGTAAAAAATTGGTATGATTCGCATATGCCAGAAAGCTTGAAAA
TATATACAGAACTCGATCATGCAAATTCTAGATTTATGGATGGACTATCTAAACTAGATCGCTTACACGAGACTC
ATGACGATTACAGCGATCAGATATTTGAGTCTCTTGAGAGGAATGACTGTACCTGTCAAAAGTATCCTGAAATCA
CAGAAGTTAGAGATGCAGTTGCCACAATTAGACGTTCCTTTAGAAAAATAACTAAAGAATCTGGTGCCGATATC
GAACCTCCCGTACAAACTAGCTTATTGGATGATTGCCAGACCTTAAAAGGAGTTCTTACTTGCTTAATACCTGGT
GCTGGTGGTTATGACGCCATTGCAGTGATTACTAAGCAAGATGTTGATCTTAGGGCTCAAACCGCTAATGACAA
AAGATTTTCTAAGGTTCAATGGCTGGATGTAACTCAGGCTGACTGGGGTGTTAGGAAAGAAAAAGATCCGGAAA
CTTATCTTGATAAATAA

Figure 12A (continued)

Diphosphomevalonate Decarboxylase

ATGACCGTTTACACAGCATCCGTTACCGCACCCGTCAACATCGCAACCCTTAAGTATTGGGGGAAAAGGGACA
CGAAGTTGAATCTGCCCACCAATTCGTCCATATCAGTGACTTTATCGCAAGATGACCTCAGAACGTTGACCTCT
GCGGCTACTGCACCTGAGTTTGAACGCGACACTTTGTGGTTAAATGGAGAACCACACAGCATCGACAATGAAA
GAACTCAAAATTGTCTGCGCGACCTACGCCAATTAAGAAAGGAAATGGAATCGAAGGACGCCTCATTGCCCAC
ATTATCTCAATGGAAACTCCACATTGTCTCCGAAAATAACTTTCCTACAGCAGCTGGTTTAGCTTCCTCCGCTGC
TGGCTTTGCTGCATTGGTCTCTGCAATTGCTAAGTTATACCAATTACCACAGTCAACTTCAGAAATATCTAGAAT
AGCAAGAAAGGGGTCTGGTTCAGCTTGTAGATCGTTGTTTGGCGGATACGTGGCCTGGGAAATGGGAAAAGCT
GAAGATGGTCATGATTCCATGGCAGTACAAATCGCAGACAGCTCTGACTGGCCTCAGATGAAAGCTTGTGTCCT
AGTTGTCAGCGATATTAAAAAGGATGTGAGTTCCACTCAGGGTATGCAATTGACCGTGGCAACCTCCGAACTAT
TTAAAGAAAGAATTGAACATGTCGTACCAAAGAGATTTGAAGTCATGCGTAAAGCCATTGTTGAAAAAGATTTCG
CCACCTTTGCAAAGGAAACAATGATGGATTCCAACTCTTTCCATGCCACATGTTTGGACTCTTTCCCTCCAATAT
TCTACATGAATGACACTTCCAAGCGTATCATCAGTTGGTGCCACACCATTAATCAGTTTTACGGAGAAACAATCG
TTGCATACACGTTTGATGCAGGTCCAAATGCTGTGTTGTACTACTTAGCTGAAAATGAGTCGAAACTCTTTGCAT
TTATCTATAAATTGTTTGGCTCTGTTCCTGGATGGGACAAGAAATTTACTACTGAGCAGCTTGAGGCTTTCAACC
ATCAATTTGAATCATCTAACTTTACTGCACGTGAATTGGATCTTGAGTTGCAAAAGGATGTTGCCAGAGTGATTT
TAACTCAAGTCGGTTCAGGCCCACAAGAAACAAACGAATCTTTGATTGACGCAAAGACTGGTCTACCAAAGGAA
TAA

Isopentenyl-Diphosphate Delta-Isomerase

ATGACTGCCGACAACAATAGTATGCCCCATGGTGCAGTATCTAGTTACGCCAAATTAGTGCAAAACCAAACACC
TGAAGACATTTTGGAAGAGTTTCCTGAAATTATTCCATTACAACAAAGACCTAATACCCGATCTAGTGAGACGTC
AAATGACGAAAGCGGAGAAACATGTTTTTCTGGTCATGATGAGGAGCAAATTAAGTTAATGAATGAAAATTGTAT
TGTTTTGGATTGGGACGATAATGCTATTGGTGCCGGTACCAAGAAAGTTTGTCATTTAATGGAAAATATTGAAAA
GGGTTTACTACATCGTGCATTCTCCGTCTTTATTTTCAATGAACAAGGTGAATTACTTTTACAACAAAGAGCCAC
TGAAAAAATAACTTTCCCTGATCTTTGGACTAACACATGCTGCTCTCATCCACTATGTATTGATGACGAATTAGG
TTTGAAGGGTAAGCTAGACGATAAGATTAAGGGCGCTATTACTGCGGCGGTGAGAAAACTAGATCATGAATTAG
GTATTCCAGAAGATGAAACTAAGACAAGGGGTAAGTTTCACTTTTTAAACAGAATCCATTACATGGCACCAAGCA
ATGAACCATGGGGTGAACATGAAATTGATTACATCCTATTTTATAAGATCAACGCTAAAGAAAACTTGACTGTCA
ACCCAAACGTCAATGAAGTTAGAGACTTCAAATGGGTTTCACCAAATGATTTGAAAACTATGTTTGCTGACCCAA
GTTACAAGTTTACGCCTTGGTTTAAGATTATTTGCGAGAATTACTTATTCAACTGGTGGGAGCAATTAGATGACC
TTTCTGAAGTGGAAAATGACAGGCAAATTCATAGAATGCTATAA

Geranyl-Diphosphate Synthase (ERG20$^{WW}$)

ATGGCTTCAGAAAAGGAAATAAGAAGAGAAAGATTCTTGAACGTATTCCCAAAGTTAGTTGAAGAATTGAACGCT
AGTTTGTTAGCTTATGGTATGCCTAAAGAAGCCTGCGATTGGTATGCTCACTCTTTAAACTACAATACTCCAGGT
GGTAAATTGAATAGAGGTTTGAGTGTAGTTGATACTTATGCTATCTTGTCTAACAAAACCGTTGAACAATTAGGT
CAAGAAGAATACGAAAAGGTCGCTATCTTGGGTTGGTGTATTGAATTGTTGCAAGCATACTTTTGGTTGCCGAT
GACATGATGGATAAGTCTATAACAAGAAGAGGTCAACCATGCTGGTACAAAGTTCCAGAAGTTGGTGAAATAGC
CATAAATGATGCTTTTATGTTGGAAGCCGCTATCTATAAATTGTTGAAGTCACATTTCAGAAACGAAAAGTACTA
CATCGATATTACCGAATTATTCCACGAAGTTACTTTCCAAACAGAATTGGGTCAATTGATGGATTTGATAACTGC
ACCTGAAGATAAAGTTGACTTGTCAAAGTTTTCCTTGAAGAAACATTCATTCATCGTCACCTTTGAAACTGCTTAT
TACTCCTTCTATTTGCCAGTCGCCTTGGCTATGTACGTAGCTGGTATTACTGATGAAAAGACTTGAAGCAAGCA
AGAGATGTTTTGATACCTTTGGGTGAATACTTCCAAATCCAAGATGACTACTTAGACTGTTTCGGTACTCCAGAA
CAAATAGGTAAAATCGGTACAGATATTCAAGACAATAAGTGCAGTTGGGTTATTAACAAGGCTTTGGAATTAGCA
TCTGCCGAACAAAGAAAGACTTTGGATGAAAACTACGGTAAAAAGGACTCAGTTGCTGAAGCAAAGTGTAAGAA
AATTTTTAATGATTTGAAGATTGAACAATTGTACCATGAATACGAAGAATCCATCGCTAAAGACTTAAAGGCAAA
GATTAGTCAAGTTGATGAATCAAGAGGTTTTAAAGCCGACGTTTTGACAGCTTTCTTGAATAAGGTCTACAAGAG
ATCAAAGTAG

Figure 12A (continued)

Olivetol Synthase

ATGAATCATTTGAGAGCTGAAGGTCCAGCTTCTGTTTTGGCTATTGGTACTGCTAATCCAGAAAATATTTTGTTG
CAAGATGAATTTCCAGATTATTATTTTAGAGTTACTAAATCTGAACATATGACTCAATTGAAAGAAAAATTTAGAA
AAATTTGTGATAAATCTATGATTAGAAAAAGAAATTGTTTTTTGAATGAAGAACATTTGAAACAAAATCCAAGATT
GGTTGAACATGAAATGCAAACTTTGGATGCTAGACAAGATATGTTGGTTGTTGAAGTTCCAAAATTGGGTAAAGA
TGCTTGTGCTAAAGCTATTAAAGAATGGGGTCAACCAAAATCTAAAATTACTCATTTGATTTTTACTTCTGCTTCT
ACTACTGATATGCCAGGTGCTGATTATCATTGTGCTAAATTGTGGGTTTGTCTCCATCTGTTAAAAGAGTTATG
ATGTATCAATTGGGTTGTTATGGTGGTGGTACTGTTTTGAGAATTGCTAAAGATATTGCTGAAAATAATAAAGGT
GCTAGAGTTTTGGCTGTTTGTTGTGATATTATGGCTTGTTTGTTTAGAGGTCCATCTGAATCTGATTTGGAATTG
TTGGTTGGTCAAGCTATTTTTGGTGATGGTGCTGCTGCTGTTATTGTTGGTGCTGAACCAGATGAATCTGTTGG
TGAAAGACCAATTTTTGAATTGGTTTCTACTGGTCAAACTATTTTGCCAAATTCTGAAGGTACTATTGGTGGTCAT
ATTAGAGAAGCTGGTTTGATTTTTGATTTGCATAAAGATGTTCCAATGTTGATTTCTAATAATATTGAAAATGTTT
GATTGAAGCTTTTACTCCAATTGGTATTTCTGATTGGAATTCTATTTTTTGGATTACTCATCCAGGTGGTAAAGCT
ATTTTGGATAAAGTTGAAGAAAAATTGCATTTGAAATCTGATAAATTTGTTGATTCTAGACATGTTTTGTCTGAAC
ATGGTAATATGTCTTCTTCTACTGTTTTGTTTGTTATGGATGAATTGAGAAAAAGATCTTTGGAAGAAGGTAAATC
TACTACTGGTGATGGTTTTGAATGGGGTGTTTTGTTTGGTTTTGGTCCAGGTTTGACTGTTGAAAGAGTTGTTGT
TAGATCTGTTCCAATTAAATAT

Olivetolic Acid Cyclase

ATGGCTGTTAAACATTTGATTGTTTTGAAATTTAAAGATGAAATTACTGAAGCTCAAAAAGAAGAATTTTTTAAAA
CTTATGTTAATTTGGTTAATATTATTCCAGCTATGAAAGATGTTTATTGGGGTAAAGATGTTACTCAAAAAAATAA
AGAAGAAGGTTATACTCATATTGTTGAAGTTACTTTTGAATCTGTTGAAACTATTCAAGATTATATTATTCATCCA
GCTCATGTTGGTTTTGGTGATGTTTATAGATCTTTTTGGGAAAAATTGTTGATTTTTGATTATACTCCAAGAAAA

CBGA Synthase

ATGGGTTTGTCTTCTGTTTGTACTTTTTCTTTTCAAACTAATTATCATACTTTGTTGAATCCACATAATAATAATCC
AAAAACTTCTTTGTTGTGTTATAGACATCCAAAAACTCCAATTAAATATTCTTATAATAATTTTCCATCTAAACATT
GTTCTACTAAATCTTTTCATTTGCAAAATAAATGTTCTGAATCTTTGTCTATTGCTAAAAATTCTATTAGAGCTGCT
ACTACTAATCAAACTGAACCACCAGAATCTGATAATCATTCTGTTGCTACTAAAATTTTGAATTTTGGTAAAGCTT
GTTGGAAATTGCAAAGACCATATACTATTATTGCTTTTACTTCTTGTGCTTGTGGTTTGTTTGGTAAAGAATTGTT
GCATAATACTAATTTGATTTCTTGGTCTTTGATGTTTAAAGCTTTTTTTTTTTTGGTTGCTATTTTGTGTATTGCTT
CTTTTACTACTACTATTAATCAAATTTATGATTTGCATATTGATAGAATTAATAAACCAGATTTGCCATTGGCTTCT
GGTGAAATTTCTGTTAATACTGCTTGGATTATGTCTATTATTGTTGCTTTGTTTGGTTTGATTATTACTATTAAAAT
GAAAGGTGGTCCATTGTATATTTTTGGTTATTGTTTTGGTATTTTTGGTGGTATTGTTTATTCTGTTCCACCATTTA
GATGGAAACAAAATCCATCTACTGCTTTTTTGTTGAATTTTTTGGCTCATATTATTACTAATTTTACTTTTTATTAT
GCTTCTAGAGCTGCTTTGGGTTTGCCATTTGAATTGAGACCATCTTTTACTTTTTTGTTGGCTTTTATGAAATCTA
TGGGTTCTGCTTTGGCTTTGATTAAAGATGCTTCTGATGTTGAAGGTGATACTAAATTTGGTATTTCTACTTTGG
CTTCTAAATATGGTTCTAGAAATTTGACTTTGTTTTGTTCTGGTATTGTTTTGTTGTCTTATGTTGCTGCTATTTTG
GCTGGTATTATTTGGCCACAAGCTTTTAATTCTAATGTTATGTTGTTGTCTCATGCTATTTTGGCTTTTTGGTTGA
TTTTGCAAACTAGAGATTTTGCTTTGACTAATTATGATCCAGAAGCTGGTAGAAGATTTTATGAATTTATGTGGAA
ATTGTATTATGCTGAATATTTGGTTTATGTTTTTATT

Figure 12A (continued)

Acetyl-CoA Carboxylase

```
ATGAGCGAAGAAAGCTTATTCGAGTCTTCTCCACAGAAGATGGAGTACGAAATTACAAACTACTCAGAAAGACA
TACAGAACTTCCAGGTCATTTCATTGGCCTCAATACAGTAGATAAACTAGAGGAGTCCCCGTTAAGGGACTTTG
TTAAGAGTCACGGTGGTCACACGGTCATATCCAAGATCCTGATAGCAAATAATGGTATTGCCGCCGTGAAAGAA
ATTAGATCCGTCAGAAAATGGGCATACGAGACGTTCGGCGATGACAGAACCGTCCAATTCGTCGCCATGGCCA
CCCCAGAAGATCTGGAGGCCAACGCAGAATATATCCGTATGGCCGATCAATACATTGAAGTGCCAGGTGGTAC
TAATAATAACAACTACGCTAACGTAGACTTGATCGTAGACATCGCCGAAAGAGCAGACGTAGACGCCGTATGG
GCTGGCTGGGGTCACGCCTCCGAGAATCCACTATTGCCTGAAAAATTGTCCCAGTCTAAGAGGAAAGTCATCTT
TATTGGGCCTCCAGGTAACGCCATGAGGTCTTTAGGTGATAAAATCTCCTCTACCATTGTCGCTCAAAGTGCTA
AAGTCCCATGTATTCCATGGTCTGGTACCGGTGTTGACACCGTTCACGTGGACGAGAAACCGGTCTGGTCTC
TGTCGACGATGACATCTATCAAAAGGGTTGTTGTACCTCTCCTGAAGATGGTTTACAAAAGGCCAAGCGTATTG
GTTTTCCTGTCATGATTAAGGCATCCGAAGGTGGTGGTGGTAAAGGTATCAGACAAGTTGAACGTGAAGAAGAT
TTCATCGCTTTATACCACCAGGCAGCCAACGAAATTCCAGGCTCCCCCATTTTCATCATGAAGTTGGCCGGTAG
AGCGCGTCACTTGGAAGTTCAACTGCTAGCAGATCAGTACGGTACAAATATTTCCTTGTTCGGTAGAGACTGTT
CCGTTCAGAGACGTCATCAAAAAATTATCGAAGAAGCACCAGTTACAATTGCCAAGGCTGAAACATTTCACGAG
ATGGAAAAGGCTGCCGTCAGACTGGGGAAACTAGTCGGTTATGTCTCTGCCGGTACCGTGGAGTATCTATATT
CTCATGATGATGGAAAATTCTACTTTTTAGAATTGAACCCAAGATTACAAGTCGAGCATCCAACAACGGAAATGG
TCTCCGGTGTTAACTTACCTGCAGCTCAATTACAAATCGCTATGGGTATCCCTATGCATAGAATAAGTGACATTA
GAACTTTATATGGTATGAATCCTCATTCTGCCTCAGAAATCGATTTCGAATTCAAAACTCAAGATGCCACCAAGA
AACAAAGAAGACCTATTCCAAAGGGTCATTGTACCGCTTGTCGTATCACATCAGAAGATCCAAACGATGGATTC
AAGCCATCGGGTGGTACTTTGCATGAACTAAACTTCCGTTCTTCCTCTAATGTTTGGGGTTACTTCTCCGTGGG
TAACAATGGTAATATTCACTCCTTTTCGGACTCTCAGTTCGGCCATATTTTGCTTTTGGTGAAAATAGACAAGCT
TCCAGGAAACACATGGTTGTTGCCCTGAAGGAATTGTCCATTAGGGGTGATTTCAGAACTACTGTGGAATACTT
GATCAAACTTTTGGAAACTGAAGATTTCGAGGATAACACTATTACCACCGGTTGGTTGGACGATTTGATTACTCA
TAAAAATGACCGCTGAAAAGCCTGATCCAACTCTTGCCGTCATTTGCGGTGCCGCTACAAAGGCTTTCTTAGCAT
CTGAAGAAGCCCGCCACAAGTATATCGAATCCTTACAAAAGGGACAAGTTCTATCTAAAGACCTACTGCAAACT
ATGTTCCCTGTAGATTTTATCCATGAGGGTAAAAGATACAAGTTCACCGTAGCTAAATCCGGTAATGACCGTTAC
ACATTATTTATCAATGGTTCTAAATGTGATATCATACTGCGTCAACTATCTGATGGTGGTCTTTTGATTGCCATAG
GCGGTAAATCGCATACCATCTATTGGAAAGAAGAAGTTGCTGCTACAAGATTATCCGTTGACTCTATGACTACTT
TGTTGGAAGTTGAAAACGATCCAACCCAGTTGCGTACTCCATCCCCTGGTAAATTGGTTAAATTCTTGGTGGAA
AATGGTGAACACATTATCAAGGGCCAACCATATGCAGAAATTGAAGTTATGAAAATGCAAATGCCTTTGGTTTCT
CAAGAAAATGGTATCGTCCAGTTATTAAAGCAACCTGGTTCTACCATTGTTGCAGGTGATATCATGGCTATTATG
ACTCTTGACGATCCATCCAAGGTCAAGCACGCTCTACCATTTGAAGGTATGCTGCCAGATTTTGGTTCTCCAGT
TATCGAAGGAACCAAACCTGCCTATAAATTCAAGTCATTAGTGTCTACTTTGGAAAACATTTTGAAGGGTTATGA
CAACCAAGTTATTATGAACGCTTCCTTGCAACAATTGATAGAGGTTTTGAGAAATCCAAAACTGCCTTACTCAGA
ATGGAAACTACACATCTCTGCTTTACATTCAAGATTGCCTGCTAAGCTAGATGAACAAATGGAAGAGTTAGTTGC
ACGTTCTTTGAGACGTGGTGCTGTTTTCCCAGCTAGACAATTAAGTAAATTGATTGATATGGCCGTGAAGAATCC
TGAATACAACCCCGACAAATTGCTGGGCGCCGTCGTGGAACCATTGGCGGATATTGCTCATAAGTACTCTAAC
GGGTTAGAAGCCCATGAACATTCTATATTTGTCCATTTCTTGGAAGAATATTACGAAGTTGAAAAGTTATTCAAT
GGTCCAAATGTTCGTGAGGAAAATATCATTCTGAAATTGCGTGATGAAAACCCTAAAGATCTAGATAAAGTTGCG
CTAACTGTTTTGTCTCATTCGAAAGTTTCAGCGAAGAATAACCTGATCCTAGCTATCTTGAAACATTATCAACCAT
TGTGCAAGTTATCTTCTAAAGTTTCTGCCATTTTCTCTACTCCTCTACAACATATTGTTGAACTAGAATCTAAGGC
TACCGCTAAGGTCGCTCTACAAGCAAGAGAAATTTTGATTCAAGGCGCTTTACCTTCGGTCAAGGAAAGAACTG
AACAAATTGAACATATCTTAAAATCCTCTGTTGTGAAGGTTGCCTATGGCTCATCCAATCCAAAGCGCTCTGAAC
CAGATTTGAATATCTTGAAGGACTTGATCGATTCTAATTACGTTGTGTTCGATGTTTTACTTCAATTCCTAACCCA
TCAAGACCCAGTTGTGACTGCTGCAGCTGCTCAAGTCTATATTCGTCGTGCTTATCGTGCTTACACCATAGGAG
ATATTAGAGTTCACGAAGGTGTCACAGTTCCAATTGTTGAATGGAAATTCCAACTACCTTCAGCTGCGTTCTCCA
CCTTTCCAACTGTTAAATCTAAAATGGGTATGAACAGGGCTGTTTCTGTTTCAGATTTGTCATATGTTGCAAACA
GTCAGTCATCTCCGTTAAGAGAAGGTATTTTGATGGCTGTGGATCATTTAGATGATGTTGATGAAATTTTGTCAC
AAAGTTTGGAAGTTATTCCTCGTCACCAATCTTCTTCTAACGGACCTGCTCCTGATCGTTCTGGTAGCTCCGCAT
CGTTGAGTAATGTTGCTAATGTTTGTGTTGCTTCTACAGAAGGTTTCGAATCTGAAGAGGAAATTTTGGTAAGGT
TGAGAGAAATTTTGGATTTGAATAAGCAGGAATTAATCAATGCTTCTATCCGTCGTATCACATTTATGTTCGGTTT
TAAAGATGGGTCTTATCCAAAGTATTATACTTTTAACGGTCCAAATTATAACGAAAATGAAACAATTCGTCACATT
```

Figure 12A (continued)

```
GAGCCGGCTTTGGCCTTCCAACTGGAATTAGGAAGATTGTCCAACTTCAACATTAAACCAATTTTCACTGATAAT
AGAAACATCCATGTCTACGAAGCTGTTAGTAAGACTTCTCCATTGGATAAGAGATTCTTTACAAGAGGTATTATT
AGAACGGGTCATATCCGTGATGACATTTCTATTCAAGAATATCTGACTTCTGAAGCTAACAGATTGATGAGTGAT
ATATTGGATAATTTAGAAGTCACCGACACTTCAAATTCTGATTTGAATCATATCTTCATCAACTTCATTGCGGTGT
TTGATATCTCTCCAGAAGATGTCGAAGCCGCCTTCGGTGGTTTCTTAGAAAGATTTGGTAAGAGATTGTTGAGA
TTGCGTGTTTCTTCTGCCGAAATTAGAATCATCATCAAAGATCCTCAAACAGGTGCCCCAGTACCATTGCGTGC
CTTGATCAATAACGTTTCTGGTTATGTTATCAAAACAGAAATGTACACCGAAGTCAAGAACGCAAAAGGTGAATG
GGTATTTAAGTCTTTGGGTAAACCTGGATCCATGCATTTAAGACCTATTGCTACTCCTTACCCTGTTAAGGAATG
GTTGCAACCAAAACGTTATAAGGCACACTTGATGGGTACCACATATGTCTATGACTTCCCAGAATTATTCCGCCA
AGCATCGTCATCCCAATGGAAAAATTTCTCTGCAGATGTTAAGTTAACAGATGATTTCTTTATTTCCAACGAGTT
GATTGAAGATGAAAACGGCGAATTAACTGAGGTGGAAAGAGAACCTGGTGCCAACGCTATTGGTATGGTTGCC
TTTAAGATTACTGTAAAGACTCCTGAATATCCAAGAGGCCGTCAATTTGTTGTTGTTGCTAACGATATCACATTC
AAGATCGGTTCCTTTGGTCCACAAGAAGACGAATTCTTCAATAAGGTTACTGAATATGCTAGAAAGCGTGGTAT
CCCAAGAATTTACTTGGCTGCAAACTCAGGTGCCAGAATTGGTATGGCTGAAGAGATTGTTCCACTATTTCAAG
TTGCATGGAATGATGCTGCCAATCCGGACAAGGGCTTCCAATACTTATACTTAACAAGTGAAGGTATGGAAACT
TTAAAGAAATTTGACAAAGAAATTCTGTTCTCACTGAACGTACTGTTATAAACGGTGAAGAAAGATTTGTCATCA
AGACAATTATTGGTTCTGAAGATGGGTTAGGTGTCGAATGTCTACGTGGATCTGGTTTAATTGCTGGTGCAACG
TCAAGGGCTTACCACGATATCTTCACTATCACCTTAGTCACTTGTAGATCCGTCGGTATCGGTGCTTATTTGGTT
CGTTTGGGTCAAAGAGCTATTCAGGTCGAAGGCCAGCCAATTATTTTAACTGGTGCTCCTGCAATCAACAAAAT
GCTGGGTAGAGAAGTTTATACTTCTAACTTACAATTGGGTGGTACTCAAATCATGTATAACAACGGTGTTTCACA
TTTGACTGCTGTTGACGATTTAGCTGGTGTAGAGAAGATTGTTGAATGGATGTCTTATGTTCCAGCCAAGCGTA
ATATGCCAGTTCCTATCTTGGAAACTAAAGACACATGGGATAGACCAGTTGATTTCACTCCAACTAATGATGAAA
CTTACGATGTAAGATGGATGATTGAAGGTCGTGAGACTGAAAGTGGATTTGAATATGGTTTGTTTGATAAAGGG
TCTTTCTTTGAAACTTTGTCAGGATGGGCCAAAGGTGTTGTCGTTGGTAGAGCCCGTCTTGGTGGTATTCCACT
GGGTGTTATTGGTGTTGAAACAAGAACTGTCGAGAACTTGATTCCTGCTGATCCAGCTAATCCAAATAGTGCTG
AAACATTAATTCAAGAACCTGGTCAAGTTTGGCATCCAAACTCCGCCTTCAAGACTGCTCAAGCTATCAATGACT
TTAACAACGGTGAACAATTGCCAATGATGATTTTGGCCAACTGGAGAGGTTTCTCTGGTGGTCAACGTGATATG
TTCAACGAAGTCTTGAAGTATGGTTCGTTTATTGTTGACGCATTGGTGGATTACAAACAACCAATTATTATCTATA
TCCCACCTACCGGTGAACTAAGAGGTGGTTCATGGGTTGTTGTCGATCCAACTATCAACGCTGACCAAATGGAA
ATGTATGCCGACGTCAACGCTAGAGCTGGTGTTTTGGAACCACAAGGTATGGTTGGTATCAAGTTCCGTAGAGA
AAAATTGCTGGACACCATGAACAGATTGGATGACAAGTACAGAGAATTGAGATCTCAATTATCCAACAAGAGTTT
GGCTCCAGAAGTACATCAGCAAATATCCAAGCAATTAGCTGATCGTGAGAGAGAACTATTGCCAATTTACGGAC
AAATCAGTCTTCAATTTGCTGATTTGCACGATAGGTCTTCACGTATGGTGGCCAAGGGTGTTATTTCTAAGGAAC
TGGAATGGACCGAGGCACGTCGTTTCTTCTTCTGGAGATTGAGAAGAAGATTGAACGAAGAATATTTGATTAAA
AGGTTGAGCCATCAGGTAGGCGAAGCATCAAGATTAGAAAAGATCGCAAGAATTAGATCGTGGTACCCTGCTT
CAGTGGACCATGAAGATGATAGGCAAGTCGCAACATGGATTGAAGAAAACTACAAAACTTTGGACGATAAACTA
AAGGGTTTGAAATTAGAGTCATTCGCTCAAGACTTAGCTAAAAAGATCAGAAGCGACCATGACAATGCTATTGAT
GGATTATCTGAAGTTATCAAGATGTTATCTACCGATGATAAAGAAAAATTGTTGAAGACTTTGAAATAA
```

CBDA Synthase

```
ATGAAATGTTCTACTTTTTCTTTTTGGTTTGTTTGTAAAATTATTTTTTTTTTTTTTCTTTTAATATTCAAACTTCTA
TTGCTAATCCAAGAGAAAATTTTTTGAAATGTTTTTCTCAATATATTCCAAATAATGCTACTAATTTGAAATTGGTT
TATACTCAAAATAATCCATTGTATATGTCTGTTTTGAATTCTACTATTCATAATTTGAGATTTACTTCTGATACTAC
TCCAAAACCATTGGTTATTGTTACTCCATCTCATGTTTCTCATATTCAAGGTACTATTTTGTGTTCTAAAAAAGTT
GGTTTGCAAATTAGAACTAGATCTGGTGGTCATGATTCTGAAGGTATGTCTTATATTTCTCAAGTTCCATTTGTTA
TTGTTGATTTGAGAAATATGAGATCTATTAAAATTGATGTTCATTCTCAAACTGCTTGGGTTGAAGCTGGTGCTA
CTTTGGGTGAAGTTTATTATTGGGTTAATGAAAAAAATGAAAATTTGTCTTTGGCTGCTGGTTATTGTCCAACTGT
TTGTGCTGGTGGTCATTTTGGTGGTGGTGGTTATGGTCCATTGATGAGAAATTATGGTTTGGCTGCTGATAATAT
TATTGATGCTCATTTGGTTAATGTTCATGGTAAAGTTTTGGATAGAAAATCTATGGGTGAAGATTTGTTTTGGGCT
TTGAGAGGTGGTGGTGCTGAATCTTTTGGTATTATTGTTGCTTGGAAAATTAGATTGGTTGCTGTTCCAAAATCT
```

Figure 12A (continued)

ACTATGTTTTCTGTTAAAAAAATTATGGAAATTCATGAATTGGTTAAATTGGTTAATAAATGGCAAAATATTGCTTA
TAAATATGATAAAGATTTGTTGTTGATGACTCATTTTATTACTAGAAATATTACTGATAATCAAGGTAAAAATAAAA
CTGCTATTCATACTTATTTTTCTTCTGTTTTTTTGGGTGGTGTTGATTCTTTGGTTGATTTGATGAATAAATCTTTT
CCAGAATTGGGTATTAAAAAAACTGATTGTAGACAATTGTCTTGGATTGATACTATTATTTTTTATTCTGGTGTTG
TTAATTATGATACTGATAATTTTAATAAAGAAATTTTGTTGGATAGATCTGCTGGTCAAAATGGTGCTTTTAAAATT
AAATTGGATTATGTTAAAAAACCAATTCCAGAATCTGTTTTTGTTCAAATTTTGGAAAAATTGTATGAAGAAGATA
TTGGTGCTGGTATGTATGCTTTGTATCCATATGGTGGTATTATGGATGAAATTTCTGAATCTGCTATTCCATTTCC
ACATAGAGCTGGTATTTTGTATGAATTGTGGTATATTTGTTCTTGGGAAAAACAAGAAGATAATGAAAAACATTTG
AATTGGATTAGAAATATTTATAATTTTATGACTCCATATGTTTCTAAAAATCCAAGATTGGCTTATTTGAATTATAG
AGATTTGGATATTGGTATTAATGATCCAAAAAATCCAAATAATTATACTCAAGCTAGAATTTGGGGTGAAAAATAT
TTTGGTAAAAATTTTGATAGATTGGTTAAAGTTAAAACTTTGGTTGATCCAAATAATTTTTTAGAAATGAACAATC
TATTCCACCATTGCCAAGACATAGACAT

CBCA Synthase

ATGAATTGTAGTACTTTCTCTTTCTGGTTTGTTTGTAAGATTATATTTTTTTTCTTAGTTTCAATATACAAATTTCA
ATTGCAAACCCTCAAGAAAATTTCCTTAAGTGCTTTTCAGAATATATCCCTAATAATCCTGCAAACCCTAAATTCA
TTTATACACAACATGATCAGTTATATATGTCTGTCTTAAACTCTACCATTCAAAATTTGAGGTTCACGTCTGATAC
AACCCCAAAGCCTTTAGTTATCGTGACACCCTCTAACGTTAGTCATATTCAGGCTAGTATCTTATGTTCAAAAAA
AGTGGGTTTACAAATCAGAACTAGGTCTGGTGGTCATGACGCGGAAGGTCTGTCTTACATATCTCAGGTGCCGT
TTGCAATCGTTGATCTACGTAATATGCATACAGTTAAAGTCGATATTCACTCTCAAACTGCATGGGTCGAGGCTG
GTGCCACTCTAGGTGAAGTTTATTACTGGATCAATGAAATGAACGAGAATTTTTCCTTCCCAGGTGGTTATTGTC
CTACTGTGGGTGTAGGCGGACACTTTTCTGGCGGGGGGTATGGTGCTTTGATGAGGAACTATGGTTTGGCCGC
CGATAATATAATTGACGCCCATCTTGTAAACGTCGACGGGAAGGTTCTGGACCGTAAATCTATGGGTGAAGATT
TATTCTGGGCGATAAGAGGTGGCGGGGGAGAGAACTTTGGTATTATCGCAGCTTGTAAGATTAAGTTAGTTGTT
GTCCCCTCAAAAGCAACAATTTTTTCAGTGAAGAAGAACATGGAAATCCACGGTTTGGTAAAACTGTTTAATAAA
TGGCAGAATATTGCCTACAAATACGATAAGGATTTGATGTTGACAACACATTTCAGAACTAGAAATATTACTGAC
AACCACGGAAAGAACAAGACAACCGTCCATGGATATTTTAGTTCTATTTTCTTAGGCGGAGTTGATTCACTAGTA
GACTTAATGAACAAGTCTTTCCCCGAATTGGGAATAAAAAAAACCGATTGCAAGGAATTATCCTGGATAGATACA
ACAATATTCTACTCTGGAGTCGTTAATTATAATACGGCCAACTTTAAGAAGGAAATATTATTAGATCGTTCCGCA
GGTAAAAAGACAGCTTTTTCCATAAAATTGGACTACGTCAAAAAATTAATTCCTGAGACAGCCATGGTAAAAATA
TTGGAAAAATTGTACGAAGAGGAGGTAGGCGTGGGTATGTATGTGTTATACCCATACGGTGGTATTATGGATGA
AATTTCTGAGAGCGCTATTCCCTTCCCCCATCGTGCAGGTATAATGTATGAATTATGGTACACAGCAACATGGG
AAAAACAAGAGGATAACGAAAAGCATATTAATTGGGTACGTAGTGTGTACAACTTTACGACACCTTACGTGTCC
CAAAATCCAAGATTAGCGTATTTGAACTATAGAGACTTAGATTTAGGTAAAACAAACCCTGAGTCTCCAAATAAT
TACACCCAAGCCAGGATTTGGGGTGAAAAATACTTCGGCAAAAATTTCAATAGATTGGTTAAGGTAAAAACTAAG
GCGGATCCAAACAATTTTTTTAGAAATGAGCAGAGTATTCCGCCCCTGCCTCCAAGACACCAT

Hexanoyl-CoA Synthetase

ATGGGTAAAAATTATAAATCTTTGGATTCTGTTGTTGCTTCTGATTTTATTGCTTTGGGTATTACTTCTGAAGTTG
CTGAAACTTTGCATGGTAGATTGGCTGAAATTGTTTGTAATTATGGTGCTGCTACTCCACAAACTTGGATTAATA
TTGCTAATCATATTTTGTCTCCAGATTTGCCATTTTCTTTGCATCAAATGTTGTTTTATGGTTGTTATAAAGATTTT
GGTCCAGCTCCACCAGCTTGGATTCCAGATCCAGAAAAAGTTAAATCTACTAATTTGGGTGCTTTGTTGGAAAA
AAGAGGTAAAGAATTTTTGGGTGTTAAATATAAAGATCCAATTTCTTCTTTTTCTCATTTTCAAGAATTTTCTGTTA
GAAATCCAGAAGTTTATTGGAGAACTGTTTTGATGGATGAAATGAAAATTTCTTTTTCTAAAGATCCAGAATGTAT
TTTGAGAAGAGATGATATTAATAATCCAGGTGGTTCTGAATGGTTGCCAGGTGGTTATTTGAATTCTGCTAAAAA
TTGTTTGAATGTTAATTCTAATAAAAAATTGAATGATACTATGATTGTTTGGAGAGATGAAGGTAATGATGATTTG
CCATTGAATAAATTGACTTTGGATCAATTGAGAAAAGAGTTTGGTTGGTTGGTTATGCTTTGGAAGAAATGGGT
TTGGAAAAAGGTTGTGCTATTGCTATTGATATGCCAATGCATGTTGATGCTGTTGTTATTTATTTGGCTATTGTTT

Figure 12A (continued)

```
TGGCTGGTTATGTTGTTGTTTCTATTGCTGATTCTTTTTCTGCTCCAGAAATTTCTACTAGATTGAGATTGTCTAA
AGCTAAAGCTATTTTTACTCAAGATCATATTATTAGAGGTAAAAAAAGAATTCCATTGTATTCTAGAGTTGTTGAA
GCTAAATCTCCAATGGCTATTGTTATTCCATGTTCTGGTTCTAATATTGGTGCTGAATTGAGAGATGGTGATATTT
CTTGGGATTATTTTTGGAAAGAGCTAAAGAATTTAAAAATTGTGAATTTACTGCTAGAGAACAACCAGTTGATG
CTTATACTAATATTTTGTTTTCTTCTGGTACTACTGGTGAACCAAAAGCTATTCCATGGACTCAAGCTACTCCATT
GAAAGCTGCTGCTGATGGTTGGTCTCATTTGGATATTAGAAAAGGTGATGTTATTGTTTGGCCAACTAATTTGGG
TTGGATGATGGGTCCATGGTTGGTTTATGCTTCTTTGTTGAATGGTGCTTCTATTGCTTTGTATAATGGTTCTCC
ATTGGTTTCTGGTTTTGCTAAATTTGTTCAAGATGCTAAAGTTACTATGTTGGGTGTTGTTCCATCTATTGTTAGA
TCTTGGAAATCTACTAATTGTGTTTCTGGTTATGATTGGTCTACTATTAGATGTTTTCTTCTTCTGGTGAAGCTT
CTAATGTTGATGAATATTTGTGGTTGATGGGTAGAGCTAATTATAAACCAGTTATTGAAATGTGTGGTGGTACTG
AAATTGGTGGTGCTTTTCTGCTGGTTCTTTTTTGCAAGCTCAATCTTTGTCTTCTTTTTCTTCTCAATGTATGGG
TTGTACTTTGTATATTTTGGATAAAAATGGTTATCCAATGCCAAAAAATAAACCAGGTATTGGTGAATTGGCTTTG
GGTCCAGTTATGTTTGGTGCTTCTAAAACTTTGTTGAATGGTAATCATCATGATGTTTATTTTAAAGGTATGCCAA
CTTTGAATGGTGAAGTTTTGAGAAGACATGGTGATATTTTTGAATTGACTTCTAATGGTTATTATCATGCTCATGG
TAGAGCTGATGATACTATGAATATTGGTGGTATTAAAATTTCTTCTATTGAAATTGAAAGAGTTTGTAATGAAGTT
GATGATAGAGTTTTTGAAACTACTGCTATTGGTGTTCCACCATTGGGTGGTGGTCCAGAACAATTGGTTATTTTT
TTTGTTTTGAAAGATTCTAATGATACTACTATTGATTTGAATCAATTGAGATTGTCTTTTAATTTGGGTTTGCAAAA
AAAATTGAATCCATTGTTTAAAGTTACTAGAGTTGTTCCATTGTCTTCTTTGCCAAGAACTGCTACTAATAAAATT
ATGAGAAGAGTTTTGAGACAACAATTTTCTCATTTTGAA
```

Figure 12B

ATP Citrate Lyase – Enzyme Linker – cTPR6 Spacer – ID Linker – ID1

```
ATGTCTGCTAAAGCTATTTCTGAACAAACTGGTAAAGAATTGTTGTATAAATTTATTTGTACTACTTCTGCTATTC
AAAATAGATTTAAATATGCTAGAGTTACTCCAGATACTGATTGGGCTAGATTGTTGCAAGATCATCCATGGTTGT
TGTCTCAAAATTTGGTTGTTAAACCAGATCAATTGATTAAAAGAAGAGGTAAATTGGGTTTGGTTGGTGTTAATTT
GACTTTGGATGGTGTTAAATCTTGGTTGAAACCAAGATTGGGTCAAGAAGCTACTGTTGGTAAAGCTACTGGTT
TTTTGAAAAATTTTTTGATTGAACCATTTGTTCCACATTCTCAAGCTGAAGAATTTTATGTTTGTATTTATGCTACT
AGAGAAGGTGATTATGTTTTGTTTCATCATGAAGGTGGTGTTGATGTTGGTGATGTTGATGCTAAAGCTCAAAAA
TTGTTGGTTGGTGTTGATGAAAAATTGAATCCAGAAGATATTAAAAAACATTTGTTGGTTCATGCTCCAGAAGAT
AAAAAAGAAATTTTGGCTTCTTTTATTTCTGGTTTGTTTAATTTTTATGAAGATTTGTATTTTACTTATTTGGAAATT
AATCCATTGGTTGTTACTAAAGATGGTGTTTATGTTTTGGATTTGGCTGCTAAAGTTGATGCTACTGCTGATTATA
TTTGTAAAGTTAAATGGGGTGATATTGAATTTCCACCACCATTTGGTAGAGAAGCTTATCCAGAAGAAGCTTATA
TTGCTGATTTGGATGCTAAATCTGGTGCTTCTTTGAAATTGACTTTGTTGAATCCAAAAGGTAGAATTTGGACTAT
GGTTGCTGGTGGTGGTGCTTCTGTTGTTTATTCTGATACTATTTGTGATTTGGGTGGTGTTAATGAATTGGCTAA
TTATGGTGAATATTCTGGTCTCCATCTGAACAACAAACTTATGATTATGCTAAAACTATTTTGTCTTTGATGACT
AGAGAAAAACATCCAGATGGTAAAATTTTGATTATTGGTGGTTCTTATTGCTAATTTTACTAATGTTGCTGCTACTT
TTAAAGGTATTGTTAGAGCTATTAGAGATTATCAAGGTCCATTGAAAGAACATGAAGTTACTATTTTTGTTAGAAG
AGGTGGTCCAAATTATCAAGAAGGTTTGAGAGTTATGGGTGAAGTTGGTAAAACTACTGGTATTCCAATTCATGT
TTTTGGTACTGAAACTCATATGACTGCTATTGTTGGTATGGCTTTGGGTCATAGACCAATTCCAAATCAACCACC
AACTGCTGCTCATACTGCTAATTTTTGTTGAATGCTTCTGGTTCTACTTCTACTCCAGCTCCATCTAGAACTGCT
TCTTTTTCTGAATCTAGAGCTGATGAAGTTGCTCCAGCTAAAAAAGCTAAACCAGCTATGCCACAAGATTCTGTT
CCATCTCCAAGATCTTTGCAAGGTAAATCTACTACTTTGTTTTCTAGACATACTAAAGCTATTGTTTGGGGTATGC
AAACTAGAGCTGTTCAAGGTATGTTGGATTTTGATTATGTTGTTCTAGAGATGAACCATCTGTTGCTGCTATGG
TTTATCCATTTACTGGTGATCATAAACAAAAATTTTATTGGGGTCATAAAGAAATTTTGATTCCAGTTTTTAAAAAT
ATGGCTGATGCTATGAGAAAACATCCAGAAGTTGATGTTTTGATTAATTTTGCTTCTTTGAGATCTGCTTATGATT
CTACTATGGAAACTATGAATTATGCTCAAATTAGAACTATTGCTATTATTGCTGAAGGTATTCCAGAAGCTTTGAC
TAGAAAATTGATTAAAAAAGCTGATCAAAAAGGTGTTACTATTATTGGTCCAGCTACTGTTGGTGGTATTAAACC
AGGTTGTTTTAAAATTGGTAATACTGGTGGTATGTTGGATAATATTTTGGCTTCTAAATTGTATAGACCAGGTTCT
```

Figure 12B (continued)

```
GTTGCTTATGTTTCTAGATCTGGTGGTATGTCTAATGAATTGAATAATATTATTTCTAGAACTACTGATGGTGTTT
ATGAAGGTGTTGCTATTGGTGGTGATAGATATCCAGGTTCTACTTTTATGGATCATGTTTTGAGATATCAAGATA
CTCCAGGTGTTAAAATGATTGTTGTTTTGGGTGAAATTGGTGGTACTGAAGAATATAAAATTTGTAGAGGTATTA
AAGAAGGTAGATTGACTAAACCAATTGTTTGTTGGTGTATTGGTACTTGTGCTACTATGTTTTCTTCTGAAGTTCA
ATTTGGTCATGCTGGTGCTTGTGCTAATCAAGCTTCTGAAACTGCTGTTGCTAAAAATCAAGCTTTGAAAGAAGC
TGGTGTTTTTGTTCCAAGATCTTTTGATGAATTGGGTGAAATTATTCAATCTGTTTATGAAGATTTGGTTGCTAAT
GGTGTTATTGTTCCAGCTCAAGAAGTTCCACCACCAACTGTTCCAATGGATTATTCTTGGGCTAGAGAATTGGG
TTTGATTAGAAAACCAGCTTCTTTTATGACTTCTATTTGTGATGAAAGAGGTCAAGAATTGATTTATGCTGGTATG
CCAATTACTGAAGTTTTTAAAGAAGAAATGGGTATTGGTGGTGTTTTGGGTTTGTTGTGGTTTCAAAAAAGATTG
CCAAAATATTCTTGTCAATTTATTGAAATGTGTTTGATGGTTACTGCTGATCATGGTCCAGCTGTTTCTGGTGCT
CATAATACTATTATTTGTGCTAGAGCTGGTAAAGATTTGGTTTCTTCTTTGACTTCTGGTTTGTTGACTATTGGTG
ATAGATTTGGTGGTGCTTTGGATGCTGCTGCTAAAATGTTTTCTAAAGCTTTTGATTCTGGTATTATTCCAATGGA
ATTTGTTAATAAAATGAAAAAAGAAGGTAAATTGATTATGGGTATTGGTCATAGAGTTAAATCTATTAATAATCCA
GATATGAGAGTTCAAATTTTGAAAGATTATGTTAGACAACATTTTCCAGCTACTCCATTGTTGGATTATGCTTTGG
AAGTTGAAAAAATTACTACTTCTAAAAAACCAAATTTGATTTTGAATGTTGATGGTTTGATTGGTGTTGCTTTTGTT
GATATGTTGAGAAATTGTGGTTCTTTTACTAGAGAAGAAGCTGATGAATATATTGATATTGGTGCTTTGAATGGT
ATTTTTGTTTTGGGTAGATCTATGGGTTTTATTGGTCATTATTTGGATCAAAAAAGATTGAAACAAGGTTTGTATA
GACATCCATGGGATGATATTTCTTATGTTTTGCCAGAACATATGTCTATGAAATTGTCTGGTGGTGGTGGTTCTG
GTGGTGGTGGTTCTGGTGGTGGTGGTTCTGCTGAAGCTTGGTATAATTTGGGTAATGCTTATTATAAACAAGGT
GATTATCAAAAAGCTATTGAATATTATCAAAAAGCTTTGGAATTGGATCCAAATAATGCTGAAGCTTGGTATAATT
TGGGTAATGCTTATTATAAACAAGGTGATTATCAAAAAGCTATTGAATATTATCAAAAAGCTTTGGAATTGGATCC
AAATAATGCTGAAGCTTGGTATAATTTGGGTAATGCTTATTATAAACAAGGTGATTATCAAAAAGCTATTGAAGAT
TATCAAAAAGCTTTGGAATTGGATCCAAATAATTTGCAAGCTGAAGCTTGGAAAATTTGGGTAATGCTTATTATA
AACAAGGTGATTATCAAAAAGCTATTGAATATTATCAAAAAGCTTTGGAATTGGATCCAAATAATGCTTCTGCTTG
GTATAATTTGGGTAATGCTTATTATAAACAAGGTGATTATCAAAAAGCTATTGAATATTATCAAAAAGCTTTGGAA
TTGGATCCAAATAATGCTAAAGCTTGGTATAGAAGAGGTAATGCTTATTATAAACAAGGTGATTATCAAAAAGCT
ATTGAAGATTATCAAAAAGCTTTGGAATTGGATCCAAATAATAGATCTAGATCTGCTGGTGGTGGTGGTTCTGGT
GGTGGTGGTTCTGGTGGTGGTGGTGCTTCTTCTTATTATCATCATCATCATCATTTGGAATCTACTTCTTTG
TATAAAAAAGCTGGTTCTGGTTCTAATTTGGTTGCTCAATTGGAAAATGAAGTTGCTTCTTTGGAAAATGAAAAT
GAAACTTTGAAAAAAAAAATTTGCATAAAAAAGATTTGATTGCTTATTTGGAAAAAGAAATTGCTAATTTGAGAA
AAAAAATTGAAGAAGGTTCTGCTGGTTCTGCTGCTGGTTCTGGTGAATTTGGTTCTGCTGAAGCTGCTGCTAAA
GAAGCTGCTGCTAAAGCTGGTTCTGCTGGTTCTGCTGCTGGTTCTGGTGAATTTGGTTCTTCTTATTATCATCAT
CATCATCATCATTTGGAATCTACTTCTTTGTATAAAAAAGCTGGTTCTGGTTCTGCTAGAAATGCTTATTTGAGAA
AAAAAATTGCTAGATTGAAAAAAGATAATTTGCAATTGGAAAGAGATGAACAAAATTTGGAAAAAATTATTGCTAA
TTTGAGAGATGAAATTGCTAGATTGGAAAATGAAGTTGCTTCTCATGAACAA
```

Acetyl-CoA Acetyltransferase (atoB) – Enzyme Linker – cTPR6 Spacer – ID Linker – ID2

```
ATGAAAAATTGTGTTATTGTTTCTGCTGTTAGAACTGCTATTGGTTCTTTTAATGGTTCTTTGGCTTCTACTTCTG
CTATTGATTTGGGTGCTACTGTTATTAAAGCTGCTATTGAAGAGCTAAAATTGATTCTCAACATGTTGATGAAGT
TATTATGGGTAATGTTTTGCAAGCTGGTTTGGGTCAAAATCCAGCTAGACAAGCTTTGTTGAAATCTGGTTTGGC
TGAAACTGTTTGTGGTTTTACTGTTAATAAAGTTTGTGGTTCTGGTTTGAAATCTGTTGCTTTGGCTGCTCAAGCT
ATTCAAGCTGGTCAAGCTCAATCTATTGTTGCTGGTGGTATGGAAAATATGTCTTTGGCTCCATATTTGTTGGAT
GCTAAAGCTAGATCTGGTTATAGATTGGGTGATGGTCAAGTTTATGATGTTATTTTGAGAGATGGTTTGATGTGT
GCTACTCATGGTTATCATATGGGTATTACTGCTGAAAATGTTGCTAAAGAATATGGTATTACTAGAGAAATGCAA
GATGAATTGGCTTTGCATTCTCAAAGAAAAGCTGCTGCTGCTATTGAATCTGGTGCTTTTACTGCTGAAATTGTT
CCAGTTAATGTTGTTACTAGAAAAAAAACTTTTGTTTTTTCTCAAGATGAATTTCCAAAAGCTAATTCTACTGCTG
AAGCTTTGGGTGCTTTGAGACCAGCTTTTGATAAAGCTGGTACTGTTACTGCTGGTAATGCTTCTGGTATTAATG
ATGGTGCTGCTGCTTTGGTTATTATGGAAGAATCTGCTGCTTTGGCTGCTGGTTTGACTCCATTGGCTAGAATTA
AATCTTATGCTTCTGGTGGTGTTCCACCAGCTTTGATGGGTATGGGTCCAGTTCCAGCTACTCAAAAAGCTTTG
CAATTGGCTGGTTTGCAATTGGCTGATATTGATTTGATTGAAGCTAATGAAGCTTTTGCTGCTCAATTTTTGGCT
```

Figure 12B (continued)

```
GTTGGTAAAAATTTGGGTTTTGATTCTGAAAAAGTTAATGTTAATGGTGGTGCTATTGCTTTGGGTCATCCAATT
GGTGCTTCTGGTGCTAGAATTTTGGTTACTTTGTTGCATGCTATGCAAGCTAGAGATAAAACTTTGGGTTTGGCT
ACTTTGTGTATTGGTGGTGGTCAAGGTATTGCTATGGTTATTGAAAGATTGAATAAATTGTCTGGTGGTGGTGGT
TCTGGTGGTGGTGGTTCTGGTGGTGGTGGTTCTGCTGAAGCTTGGTATAATTTGGGTAATGCTTATTATAAACA
AGGTGATTATCAAAAAGCTATTGAATATTATCAAAAAGCTTTGGAATTGGATCCAAATAATGCTGAAGCTTGGTA
TAATTTGGGTAATGCTTATTATAAACAAGGTGATTATCAAAAAGCTATTGAATATTATCAAAAAGCTTTGGAATTG
GATCCAAATAATGCTGAAGCTTGGTATAATTTGGGTAATGCTTATTATAAACAAGGTGATTATCAAAAAGCTATTG
AAGATTATCAAAAAGCTTTGGAATTGGATCCAAATAATTTGCAAGCTGAAGCTTGGAAAAATTTGGGTAATGCTT
ATTATAAACAAGGTGATTATCAAAAAGCTATTGAATATTATCAAAAAGCTTTGGAATTGGATCCAAATAATGCTTC
TGCTTGGTATAATTTGGGTAATGCTTATTATAAACAAGGTGATTATCAAAAAGCTATTGAATATTATCAAAAAGCT
TTGGAATTGGATCCAAATAATGCTAAAGCTTGGTATAGAAGAGGTAATGCTTATTATAAACAAGGTGATTATCAA
AAAGCTATTGAAGATTATCAAAAAGCTTTGGAATTGGATCCAAATAATAGATCTAGATCTGCTGGTGGTGGTGGT
TCTGGTGGTGGTGGTTCTGGTGGTGGTGGTGCTTCTTCTTATTATCATCATCATCATCATCATTTGGAATCTACT
TCTTTGTATAAAAAAGCTGGTTCTGGTTCTAATGAAGTTACTACTTTGGAAAATGATGCTGCTTTTATTGAAAATG
AAAATGCTTATTTGGAAAAAGAAATTGCTAGATTGAGAAAAGAAAAGCTGCTTTGAGAAATAGATTGGCTCATA
AAAAAGGTTCTGCTGGTTCTGCTGCTGGTTCTGGTGAATTTGGTTCTGCTGAAGCTGCTGCTAAAGAAGCTGCT
GCTAAAGCTGGTTCTGCTGGTTCTGCTGCTGGTTCTGGTGAATTTGGTTCTTCTTATTATCATCATCATCATCAT
CATTTGGAATCTACTTCTTTGTATAAAAAAGCTGGTTCTGGTTCTCAAAAAGTTGCTGAATTGAAAAATAGAGTTG
CTGTTAAATTGAATAGAAATGAACAATTGAAAAATAAAGTTGAAGAATTGAAAAATAGAAATGCTTATTTGAAAAA
TGAATTGGCTACTTTGGAAAATGAAGTTGCTAGATTGGAAAATGATGTTGCTGAA
```

3-Hydroxybutyryl-CoA Dehydrogenase – Enzyme Linker – cTPR6 Spacer – ID Linker – ID3

```
ATGAAAAAAGTTTGTGTTATTGGTGCTGGTACTATGGGTTCTGGTATTGCTCAAGCTTTTGCTGCTAAAGGTTTT
GAAGTTGTTTTGAGAGATATTAAAGATGAATTTGTTGATAGAGGTTTGGATTTTATTAATAAAAATTTGTCTAAATT
GGTTAAAAAAGGTAAAATTGAAGAAGCTACTAAAGTTGAAATTTTGACTAGAATTTCTGGTACTGTTGATTTGAAT
ATGGCTGCTGATTGTGATTTGGTTATTGAAGCTGCTGTTGAAAGAATGGATATTAAAAAACAAATTTTTGCTGATT
TGGATAATATTTGTAAACCAGAAACTATTTTGGCTTCTAATACTTCTTCTTTGTCTATTACTGAAGTTGCTTCTGCT
ACTAAAAGACCAGATAAAGTTATTGGTATGCATTTTTTTAATCCAGCTCCAGTTATGAAATTGGTTGAAGTTATTA
GAGGTATTGCTACTTCTCAAGAAACTTTTGATGCTGTTAAAGAAACTTCTATTGCTATTGGTAAAGATCCAGTTG
AAGTTGCTGAAGCTCCAGGTTTTGTTGTTAATAGAATTTTGATTCCAATGATTAATGAAGCTGTTGGTATTTTGGC
TGAAGGTATTGCTTCTGTTGAAGATATTGATAAAGCTATGAAATTGGGTGCTAATCATCCAATGGGTCCATTGGA
ATTGGGTGATTTTATTGGTTTGGATATTTGTTTGGCTATTATGGATGTTTTGTATTCTGAAACTGGTGATTCTAAA
TATAGACCACATACTTTGTTGAAAAAATATGTTAGAGCTGGTTGGTTGGGTAGAAAATCTGGTAAAGGTTTTTAT
GATTATTCTAAAAAATTGTCTGGTGGTGGTGGTTCTGGTGGTGGTGGTTCTGGTGGTGGTGGTTCTGCTGAAGC
TTGGTATAATTTGGGTAATGCTTATTATAAACAAGGTGATTATCAAAAAGCTATTGAATATTATCAAAAAGCTTTG
GAATTGGATCCAAATAATGCTGAAGCTTGGTATAATTTGGGTAATGCTTATTATAAACAAGGTGATTATCAAAAA
GCTATTGAATATTATCAAAAAGCTTTGGAATTGGATCCAAATAATGCTGAAGCTTGGTATAATTTGGGTAATGCTT
ATTATAAACAAGGTGATTATCAAAAAGCTATTGAAGATTATCAAAAAGCTTTGGAATTGGATCCAAATAATTTGCA
AGCTGAAGCTTGGAAAAATTTGGGTAATGCTTATTATAAACAAGGTGATTATCAAAAAGCTATTGAATATTATCAA
AAAGCTTTGGAATTGGATCCAAATAATGCTTCTGCTTGGTATAATTTGGGTAATGCTTATTATAAACAAGGTGATT
ATCAAAAAGCTATTGAATATTATCAAAAAGCTTTGGAATTGGATCCAAATAATGCTAAAGCTTGGTATAGAAGAG
GTAATGCTTATTATAAACAAGGTGATTATCAAAAAGCTATTGAAGATTATCAAAAAGCTTTGGAATTGGATCCAAA
TAATAGATCTAGATCTGCTGGTGGTGGTGGTTCTGGTGGTGGTGGTTCTGGTGGTGGTGGTGCTTCTGAAAATT
TGTATTTTCAAGGTGAAATTTGTATTTTCAAGGTGATTCTTCTGAATCTTGTTGGAATTGTGGTAGAAAAGCTTC
TGAAACTTGTTCTGGTTGTAATACTGCTAGATATTGTGGTTCTTTTTGTCAACATAAAGATTGGGAAAAACATCAT
CATATTTGTGGTCAAACTTTGCAAGCTCAACAAGGTTCTGCTGGTTCTGCTGCTGGTTCTGGTGAATTTGGTTCT
GCTGAAGCTGCTGCTAAAGAAGCTGCTGCTAAAGCTGGTTCTGCTGGTTCTGCTGCTGGTTCTGGTGAATTTG
GTTCTATGGCTGTTTCTGAATCTCAATTGAAAAAAATGGTTTCTAAATATAAATATAGAGATTTGACTGTTAGAGA
AACTGTTAATGTTATTACTTTGTATAAAGATTTGAAACCAGTTTTGGATTCTTATGTTTTTAATGATGGTTCTTCTA
GAGAATTGATGAATTTGACTGGTACTATTCCAGTTCCATATAGAGGTAATACTTATAATATTCCAATTTGTTTGTG
```

Figure 12B (continued)

GTTGTTGGATACTTATCCATATAATCCACCAATTTGTTTTGTTAAACCAACTTCTTCTATGACTATTAAAACTGGTA
AACATGTTGATGCTAATGGTAAAATTTATTTGCCATATTTGCATGAATGGAAACATCCACAATCTGATTTGTTGGG
TTTGATTCAAGTTATGATTGTTGTTTTGGTGATGAACCACCAGTTTTTTCTAGACCA

Enoyl-CoA Hydratase – Enzyme Linker – cTPR6 Spacer – ID Linker – ID4

ATGGAATTGAATAATGTTATTTTGGAAAAAGAAGGTAAAGTTGCTGTTGTTACTATTAATAGACCAAAAGCTTTGA
ATGCTTTGAATTCTGATACTTTGAAAGAAATGGATTATGTTATTGGTGAAATTGAAAATGATTCTGAAGTTTTGGC
TGTTATTTTGACTGGTGCTGGTGAAAAATCTTTTGTTGCTGGTGCTGATATTTCTGAAATGAAAGAAATGAATACT
ATTGAAGGTAGAAAATTTGGTATTTTGGGTAATAAAGTTTTTAGAAGATTGGAATTGTTGGAAAAACCAGTTATTG
CTGCTGTTAATGGTTTTGCTTTGGGTGGTGGTTGTGAAATTGCTATGTCTTGTGATATTAGAATTGCTTCTTCTAA
TGCTAGATTTGGTCAACCAGAAGTTGGTTTGGGTATTACTCCAGGTTTTGGTGGTACTCAAAGATTGTCTAGATT
GGTTGGTATGGGTATGGCTAAACAATTGATTTTTACTGCTCAAAATATTAAAGCTGATGAAGCTTTGAGAATTGG
TTTGGTTAATAAAGTTGTTGAACCATCTGAATTGATGAATACTGCTAAAGAAATTGCTAATAAAATTGTTTCTAAT
GCTCCAGTTGCTGTTAAATTGTCTAAACAAGCTATTAATAGAGGTATGCAATGTGATATTGATACTGCTTTGGCT
TTTGAATCTGAAGCTTTTGGTGAATGTTTTCTACTGAAGATCAAAAGATGCTATGACTGCTTTTATTGAAAAAA
GAAAAATTGAAGGTTTTAAAAATAGAAAATTGTCTGGTGGTGGTGGTTCTGGTGGTGGTGGTTCTGGTGGTGGT
GGTTCTGCTGAAGCTTGGTATAATTTGGGTAATGCTTATTATAAACAAGGTGATTATCAAAAGCTATTGAATATT
ATCAAAAAGCTTTGGAATTGGATCCAAATAATGCTGAAGCTTGGTATAATTTGGGTAATGCTTATTATAAACAAG
GTGATTATCAAAAAGCTATTGAATATTATCAAAAAGCTTTGGAATTGGATCCAAATAATGCTGAAGCTTGGTATAA
TTTGGGTAATGCTTATTATAAACAAGGTGATTATCAAAAAGCTATTGAAGATTATCAAAAAGCTTTGGAATTGGAT
CCAAATAATTTGCAAGCTGAAGCTTGGAAAAATTTGGGTAATGCTTATTATAAACAAGGTGATTATCAAAAAGCT
ATTGAATATTATCAAAAAGCTTTGGAATTGGATCCAAATAATGCTTCTGCTTGGTATAATTTGGGTAATGCTTATT
ATAAACAAGGTGATTATCAAAAAGCTATTGAATATTATCAAAAAGCTTTGGAATTGGATCCAAATAATGCTAAAGC
TTGGTATAGAAGAGGTAATGCTTATTATAAACAAGGTGATTATCAAAAAGCTATTGAAGATTATCAAAAAGCTTTG
GAATTGGATCCAAATAATAGATCTAGATCTGCTGGTGGTGGTGGTTCTGGTGGTGGTGGTTCTGGTGGTGGTG
GTGCTTCTGGTCCATTGGGTTCTCCATTGACTGCTTCTATGTTGGCTTCTGCTCCACCACAAGAACAAAAACAAA
TGTTGGGTGAAAGATTGTTTCCATTGATTCAAGCTATGCATCCAACTTTGGCTGGTAAAATTACTGGTATGTTGT
TGGAAATTGATAATTCTGAATTGTTGCATATGTTGGAATCTCCAGAATCTTTGAGATCTAAAGTTGATGAAGCTG
TTGCTGTTTTGCAAGCTCATCAAGCTAAAGAAGCTGCTCAAAAAGCTGGTTCTGCTGGTTCTGCTGCTGGTTCT
GGTGAATTTGGTTCTGCTGAAGCTGCTGCTAAAGAAGCTGCTGCTAAAGCTGGTTCTGCTGGTTCTGCTGCTG
GTTCTGGTGAATTTGGTTCTAATACTAATATGTCTGTTCCAACTGATGGTGCTGTTACTACTTCTCAAATTCCAGC
TTCTGAACAAGAAACTTTGGTTAGACCAAAACCATTGTTGTTGAAATTGTTGAAATCTGTTGGTGCTCAAAAAGA
TACTTATACTATGAAAGAAGTTTTGTTTTATTTGGGTCAATATATTATGACTAAAAGATTGTATGATGAAAACAAC
AACATATTGTTTATTGTTCTAATGATTTGTTGGGTGATTTGTTTGGTGTTCCATCTTTTTCTGTTAAAGAACATAGA
AAAATTTATACTATGATTTATAGAAATTTGGTTGTT

Trans-Enoyl-CoA Reductase – Enzyme Linker – cTPR6 Spacer – ID Linker – ID5

ATGATTGTTAAACCAATGGTTAGAAATAATATTTGTTTGAATGCTCATCCACAAGGTTGTAAAAAAGGTGTTGAA
GATCAAATTGAATATACTAAAAAAAGAATTACTGCTGAAGTTAAAGCTGGTGCTAAAGCTCCAAAAAATGTTTTG
GTTTTGGGTTGTTCTAATGGTTATGGTTTGGCTTCTAGAATTACTGCTGCTTTTGGTTATGGTGCTGCTACTATT
GGTGTTTCTTTTGAAAAAGCTGGTTCTGAAACTAAATATGGTACTCCAGGTTGGTATAATAATTTGGCTTTTGAT
GAAGCTGCTAAAAGAGAAGGTTTGTATTCTGTTACTATTGATGGTGATGCTTTTTCTGATGAAATTAAAGCTCAA
GTTATTGAAGAAGCTAAAAAAAAGGTATTAAATTTGATTTGATTGTTTATTCTTTGGCTTCTCCAGTTAGAACTG
ATCCAGATACTGGTATTATGCATAAATCTGTTTTGAAACCATTTGGTAAACTTTTACTGGTAAACTGTTGATCC
ATTTACTGGTGAATTGAAAGAAATTTCTGCTGAACCAGCTAATGATGAAGAAGCTGCTGCTACTGTTAAAGTTAT
GGGTGGTGAAGATTGGGAAAGATGGATTAAACAATTGTCTAAAGAAGGTTTGTTGGAAGAAGGTTGTATTACTT
TGGCTTATTCTTATATTGGTCCAGAAGCTACTCAAGCTTTGTATAGAAAAGGTACTATTGGTAAAGCTAAAGAAC
ATTTGGAAGCTACTGCTCATAGATTGAATAAAGAAAATCCATCTATTAGAGCTTTTGTTTCTGTTAATAAAGGTTT
GGTTACTAGAGCTTCTGCTGTTATTCCAGTTATTCCATTGTATTTGGCTTCTTTGTTTAAAGTTATGAAAGAAAAA

Figure 12B (continued)

```
GGTAATCATGAAGGTTGTATTGAACAAATTACTAGATTGTATGCTGAAAGATTGTATAGAAAAGATGGTACTATT
CCAGTTGATGAAGAAAATAGAATTAGAATTGATGATTGGGAATTGGAAGAAGATGTTCAAAAAGCTGTTTCTGCT
TTGATGGAAAAAGTTACTGGTGAAAATGCTGAATCTTTGACTGATTTGGCTGGTTATAGACATGATTTTTGGCT
TCTAATGGTTTTGATGTTGAAGGTATTAATTATGAAGCTGAAGTTGAAAGATTTGATAGAATTAAATTGTCTGGTG
GTGGTGGTTCTGGTGGTGGTGGTTCTGGTGGTGGTGGTTCTGCTGAAGCTTGGTATAATTTGGGTAATGCTTAT
TATAAACAAGGTGATTATCAAAAAGCTATTGAATATTATCAAAAAGCTTTGGAATTGGATCCAAATAATGCTGAAG
CTTGGTATAATTTGGGTAATGCTTATTATAAACAAGGTGATTATCAAAAAGCTATTGAATATTATCAAAAAGCTTT
GGAATTGGATCCAAATAATGCTGAAGCTTGGTATAATTTGGGTAATGCTTATTATAAACAAGGTGATTATCAAAA
AGCTATTGAAGATTATCAAAAAGCTTTGGAATTGGATCCAAATAATTTGCAAGCTGAAGCTTGGAAAAATTTGGG
TAATGCTTATTATAAACAAGGTGATTATCAAAAAGCTATTGAATATTATCAAAAAGCTTTGGAATTGGATCCAAAT
AATGCTTCTGCTTGGTATAATTTGGGTAATGCTTATTATAAACAAGGTGATTATCAAAAAGCTATTGAATATTATC
AAAAAGCTTTGGAATTGGATCCAAATAATGCTAAAGCTTGGTATAGAAGAGGTAATGCTTATTATAAACAAGGTG
ATTATCAAAAAGCTATTGAAGATTATCAAAAAGCTTTGGAATTGGATCCAAATAATAGATCTAGATCTGCTGGTG
GTGGTGGTTCTGGTGGTGGTGGTTCTGGTGGTGGTGGTGCTTCTTCTTATTATCATCATCATCATCATCATTTG
GAATCTACTTCTTTGTATAAAAAAGCTGGTTCTGGTTCTAATTTGTTGGCTACTTTGAGATCTACTGCTGCTGTTT
TGGAAAATGAAAATCATGTTTTGGAAAAAGAAAAAGAAAAATTGAGAAAAGAAAAAGAACAATTGTTGAATAAATT
GGAAGCTTATAAAGGTTCTGCTGGTTCTGCTGCTGGTTCTGGTGAATTTGGTTCTGCTGAAGCTGCTGCTAAAG
AAGCTGCTGCTAAAGCTGGTTCTGCTGGTTCTGCTGCTGGTTCTGGTGAATTTGGTTCTTCTTATTATCATCATC
ATCATCATCATTTGGAATCTACTTCTTTGTATAAAAAAGCTGGTTCTGGTTCTAAAAGAATTGCTTATTTGAGAAA
AAAAATTGCTGCTTTGAAAAAAGATAATGCTAATTTGGAAAAAGATATTGCTAATTTGGAAAATGAAATTGAAAGA
TTGATTAAAGAAATTAAAACTTTGGAAAATGAAGTTGCTTCTCATGAACAA
```

Beta-Ketothiolase (bktB) – Enzyme Linker – cTPR6 Spacer – ID Linker – ID6

```
ATGACTAGAGAAGTTGTTGTTGTTTCTGGTGTTAGAACTGCTATTGGTACTTTTGGTGGTTCTTTGAAAGATGTT
GCTCCAGCTGAATTGGGTGCTTTGGTTGTTAGAGAAGCTTTGGCTAGAGCTCAAGTTTCTGGTGATGATGTTGG
TCATGTTGTTTTTGGTAATGTTATTCAAACTGAACCAAGAGATATGTATTTGGGTAGAGTTGCTGCTGTTAATGG
TGGTGTTACTATTAATGCTCCAGCTTTGACTGTTAATAGATTGTGTGGTTCTGGTTTGCAAGCTATTGTTTCTGCT
GCTCAAACTATTTTGTTGGGTGATACTGATGTTGCTATTGGTGGTGGTGCTGAATCTATGTCTAGAGCTCCATAT
TTGGCTCCAGCTGCTAGATGGGGTGCTAGAATGGGTGATGCTGGTTTGGTTGATATGATGTTGGGTGCTTTGC
ATGATCCATTTCATAGAATTCATATGGGTGTTACTGCTGAAAATGTTGCTAAAGAATATGATATTTCTAGAGCTCA
ACAAGATGAAGCTGCTTTGGAATCTCATAGAAGAGCTTCTGCTGCTATTAAAGCTGGTTATTTTAAAGATCAAAT
TGTTCCAGTTGTTTCTAAAGGTAGAAAAGGTGATGTTACTTTTGATACTGATGAACATGTTAGACATGATGCTAC
TATTGATGATATGACTAAATTGAGACCAGTTTTTGTTAAAGAAAATGGTACTGTTACTGCTGGTAATGCTTCTGGT
TTGAATGATGCTGCTGCTGCTGTTGTTATGATGGAAAGAGCTGAAGCTGAAAGAAGAGGTTTGAAACCATTGGC
TAGATTGGTTTCTTATGGTCATGCTGGTGTTGATCCAAAAGCTATGGGTATTGGTCCAGTTCCAGCTACTAAAAT
TGCTTTGGAAAGAGCTGGTTTGCAAGTTTCTGATTTGGATGTTATTGAAGCTAATGAAGCTTTTGCTGCTCAAGC
TTGTGCTGTTACTAAAGCTTTGGGTTTGGATCCAGCTAAAGTTAATCCAAATGGTTCTGGTATTTCTTTGGGTCA
TCCAATTGGTGCTACTGGTGCTTTGATTACTGTTAAAGCTTTGCATGAATTGAATAGAGTTCAAGGTAGATATGC
TTTGGTTACTATGTGTATTGGTGGTGGTCAAGGTATTGCTGCTATTTTTGAAAGAATTAAATTGTCTGGTGGTGG
TGGTTCTGGTGGTGGTGGTTCTGGTGGTGGTGGTTCTGCTGAAGCTTGGTATAATTTGGGTAATGCTTATTATA
AACAAGGTGATTATCAAAAAGCTATTGAATATTATCAAAAAGCTTTGGAATTGGATCCAAATAATGCTGAAGCTT
GGTATAATTTGGGTAATGCTTATTATAAACAAGGTGATTATCAAAAAGCTATTGAATATTATCAAAAAGCTTTGGA
ATTGGATCCAAATAATGCTGAAGCTTGGTATAATTTGGGTAATGCTTATTATAAACAAGGTGATTATCAAAAAGCT
ATTGAAGATTATCAAAAAGCTTTGGAATTGGATCCAAATAATTTGCAAGCTGAAGCTTGGAAAAATTTGGGTAAT
GCTTATTATAAACAAGGTGATTATCAAAAAGCTATTGAATATTATCAAAAAGCTTTGGAATTGGATCCAAATAATG
CTTCTGCTTGGTATAATTTGGGTAATGCTTATTATAAACAAGGTGATTATCAAAAAGCTATTGAATATTATCAAAA
AGCTTTGGAATTGGATCCAAATAATGCTAAAGCTTGGTATAGAAGAGGTAATGCTTATTATAAACAAGGTGATTA
TCAAAAAGCTATTGAAGATTATCAAAAAGCTTTGGAATTGGATCCAAATAATAGATCTAGATCTGCTGGTGGTGG
TGGTTCTGGTGGTGGTTCTGGTGGTGGTGGTGCTTCTGATGTTATGTGGGAATATAAATGGGAAAATACTG
GTGATGCTGAATTGTATGGTCCATTTACTTCTGCTCAAATGCAAACTTGGGTTTCTGAAGGTTATTTTCCAGATG
GTGTTTATTGTAGAAAATTGGATCCACCAGGTGGTCAATTTTATAATTCTAAAAGAATTGATTTTGATTTGTATAC
TGGTTCTGCTGGTTCTGCTGCTGGTTCTGGTGAATTTGGTTCTGCTGAAGCTGCTGCTAAAGAAGCTGCTGCTA
```

Figure 12B (continued)

```
AAGCTGGTTCTGCTGGTTCTGCTGCTGGTTCTGGTGAATTTGGTTCTGAATCTGATTCTGTTGAATTTAATAATG
CTATTTCTTATGTTAATAAAATTAAAACTAGATTTTTGGATCATCCAGAAATTTATAGATCTTTTTTGGAAATTTTG
CATACTTATCAAAAAGAACAATTGCATACTAAAGGTAGACCATTTAGAGGTATGTCTGAAGAAGAAGTTTTTACT
GAAGTTGCTAATTTGTTTAGAGGTCAAGAAGATTTGTTGTCTGAATTTGGTCAATTTTTGCCAGAAGCTAAAAGA
```

HMG CoA Synthase – Enzyme Linker – cTPR6 Spacer – ID Linker – ID7

```
ATGAAACTCTCAACTAAACTTTGTTGGTGTGGTATTAAAGGAAGACTTAGGCCGCAAAAGCAACAACAATTACAC
AATACAAACTTGCAAATGACTGAACTAAAAAAACAAAAGACCGCTGAACAAAAAACCAGACCTCAAAATGTCGGT
ATTAAAGGTATCCAAATTTACATCCCAACTCAATGTGTCAACCAATCTGAGCTAGAGAAATTTGATGGCGTTTCT
CAAGGTAAATACACAATTGGTCTGGGCCAAACCAACATGTCTTTTGTCAATGACAGAGAAGATATCTACTCGAT
GTCCCTAACTGTTTTGTCTAAGTTGATCAAGAGTTACAACATCGACACCAACAAAATTGGTAGATTAGAAGTCGG
TACTGAAACTCTGATTGACAAGTCCAAGTCTGTCAAGTCTGTCTTGATGCAATTGTTTGGTGAAAACACTGACGT
CGAAGGTATTGACACGCTTAATGCCTGTTACGGTGGTACCAACGCGTTGTTCAACTCTTTGAACTGGATTGAAT
CTAACGCATGGGATGGTAGAGACGCCATTGTAGTTTGCGGTGATATTGCCATCTACGATAAGGGTGCCGCAAG
ACCAACCGGTGGTGCCGGTACTGTTGCTATGTGGATCGGTCCTGATGCTCCAATTGTATTTGACTCTGTAAGAG
CTTCTTACATGGAACACGCCTACGATTTTTACAAGCCAGATTTCACCAGCGAATATCCTTACGTCGATGGTCATT
TTTCATTAACTTGTTACGTCAAGGCTCTTGATCAAGTTTACAAGAGTTATTCCAAGAAGGCTATTTCTAAAGGGTT
GGTTAGCGATCCCGCTGGTTCGGATGCTTTGAACGTTTTGAAATATTTCGACTACAACGTTTTCCATGTTCCAAC
CTGTAAATTGGTCACAAAATCATACGGTAGATTACTATATAACGATTTCAGAGCCAATCCTCAATTGTTCCCAGA
AGTTGACGCCGAATTAGCTACTCGCGATTATGACGAATCTTTAACCGATAAGAACATTGAAAAAACTTTTGTTAA
TGTTGCTAAGCCATTCCACAAAGAGAGAGTTGCCCAATCTTTGATTGTTCCAACAAACACAGGTAACATGTACAC
CGCATCTGTTTATGCCGCCTTTGCATCTCTATTAAACTATGTTGGATCTGACGACTTACAAGGCAAGCGTGTTG
GTTTATTTTCTTACGGTTCCGGTTTAGCTGCATCTCTATATTCTTGCAAAATTGTTGGTGACGTCCAACATATTAT
CAAGGAATTAGATATTACTAACAAATTAGCCAAGAGAATCACCGAAACTCCAAAGGATTACGAAGCTGCCATCG
AATTGAGAGAAAATGCCCATTTGAAGAAGAACTTCAAACCTCAAGGTTCCATTGAGCATTTGCAAAGTGGTGTTT
ACTACTTGACCAACATCGATGACAAATTTAGAAGATCTTACGATGTTAAAAAATAAAAATTGTCTGGTGGTGGTG
GTTCTGGTGGTGGTGGTTCTGGTGGTGGTGGTTCTGCTGAAGCTTGGTATAATTTGGGTAATGCTTATTATAAA
CAAGGTGATTATCAAAAAGCTATTGAATATTATCAAAAAGCTTTGGAATTGGATCCAAATAATGCTGAAGCTTGG
TATAATTTGGGTAATGCTTATTATAAACAAGGTGATTATCAAAAAGCTATTGAATATTATCAAAAAGCTTTGGAAT
TGGATCCAAATAATGCTGAAGCTTGGTATAATTTGGGTAATGCTTATTATAAACAAGGTGATTATCAAAAAGCTAT
TGAAGATTATCAAAAAGCTTTGGAATTGGATCCAAATAATTTGCAAGCTGAAGCTTGGAAAAATTTGGGTAATGC
TTATTATAAACAAGGTGATTATCAAAAAGCTATTGAATATTATCAAAAAGCTTTGGAATTGGATCCAAATAATGCT
TCTGCTTGGTATAATTTGGGTAATGCTTATTATAAACAAGGTGATTATCAAAAAGCTATTGAATATTATCAAAAG
CTTTGGAATTGGATCCAAATAATGCTAAAGCTTGGTATAGAAGAGGTAATGCTTATTATAAACAAGGTGATTATC
AAAAAGCTATTGAAGATTATCAAAAAGCTTTGGAATTGGATCCAAATAATAGATCTAGATCTGCTGGTGGTGGTG
GTTCTGGTGGTGGTGGTTCTGGTGGTGGTGGTGCTTCTTTGGGTCCATTGCCACCAGGTTGGGAAGTTAGATC
TACTGTTTCTGGTAGAATTTATTTTGTTGATCATAATAATAGAACTACTCAATTTACTGATCCAAGATTGCATGGT
TCTGCTGGTTCTGCTGCTGGTTCTGGTGAATTTGGTTCTGCTGAAGCTGCTGCTAAAGAAGCTGCTGCTAAAGC
TGGTTCTGCTGGTTCTGCTGCTGGTTCTGGTGAATTTGGTTCTGGTGCTATGGGTCCATTGCCACCAGGTTGG
GAAAAAAGAACTGATTCTAATGGTAGAGTTTATTTTGTTAATCATAATACTAGAATTACTCAATGGGAAGATCCAA
GATCT
```

Truncated HMG-CoA Reductase – Enzyme Linker – cTPR6 Spacer – ID Linker – ID8

```
ATGGTTGCGGTACGTAGGAAGGCTCTTTCAATTTTGGCAGAAGCTCCTGTATTAGCATCTGATCGTTTACCATAT
AAAAATTATGACTACGACCGCGTATTTGGCGCTTGTTGTGAAAATGTTATAGGTTACATGCCTTTGCCCGTTGGT
GTTATAGGCCCCTTGGTTATCGATGGTACATCTTATCATATACCAATGGCAACTACAGAGGGTTGTTTGGTAGCT
TCTGCCATGCGTGGCTGTAAGGCAATCAATGCTGGCGGTGGTGCAACAACTGTTTTAACTAAGGATGGTATGA
CAAGAGGCCCAGTAGTCCGTTTCCCAACTTTGAAAAGATCTGGTGCCTGTAAGATATGGTTAGACTCAGAAGAG
GGACAAAACGCAATTAAAAAAGCTTTTAACTCTACATCAAGATTTGCACGTCTGCAACATATTCAAACTTGTCTA
```

Figure 12B (continued)

```
GCAGGAGATTTACTCTTCATGAGATTTAGAACAACTACTGGTGACGCAATGGGTATGAATATGATTTCTAAAGGT
GTCGAATACTCATTAAAGCAAATGGTAGAAGAGTATGGCTGGGAAGATATGGAGGTTGTCTCCGTTTCTGGTAA
CTACTGTACCGACAAAAAACCAGCTGCCATCAACTGGATCGAAGGTCGTGGTAAGAGTGTCGTCGCAGAAGCT
ACTATTCCTGGTGATGTTGTCAGAAAAGTGTTAAAAAGTGATGTTTCCGCATTGGTTGAGTTGAACATTGCTAAG
AATTTGGTTGGATCTGCAATGGCTGGGTCTGTTGGTGGATTTAACGCACATGCAGCTAATTTAGTGACAGCTGT
TTTCTTGGCATTAGGACAAGATCCTGCACAAAATGTTGAAAGTTCCAACTGTATAACATTGATGAAAGAAGTGGA
CGGTGATTTGAGAATTTCCGTATCCATGCCATCCATCGAAGTAGGTACCATCGGTGGTGGTACTGTTCTAGAAC
CACAAGGTGCCATGTTGGACTTATTAGGTGTAAGAGGCCCGCATGCTACCGCTCCTGGTACCAACGCACGTCA
ATTAGCAAGAATAGTTGCCTGTGCCGTCTTGGCAGGTGAATTATCCTTATGTGCTGCCCTAGCAGCCGGCCATT
TGGTTCAAAGTCATATGACCCACAACAGGAAATTGTCTGGTGGTGGTGGTTCTGGTGGTGGTGGTTCTGGTGG
TGGTGGTTCTGCTGAAGCTTGGTATAATTTGGGTAATGCTTATTATAAACAAGGTGATTATCAAAAAGCTATTGA
ATATTATCAAAAAGCTTTGGAATTGGATCCAAATAATGCTGAAGCTTGGTATAATTTGGGTAATGCTTATTATAAA
CAAGGTGATTATCAAAAAGCTATTGAATATTATCAAAAAGCTTTGGAATTGGATCCAAATAATGCTGAAGCTTGG
TATAATTTGGGTAATGCTTATTATAAACAAGGTGATTATCAAAAAGCTATTGAAGATTATCAAAAAGCTTTGGAAT
TGGATCCAAATAATTTGCAAGCTGAAGCTTGGAAAAATTTGGGTAATGCTTATTATAAACAAGGTGATTATCAAA
AAGCTATTGAATATTATCAAAAAGCTTTGGAATTGGATCCAAATAATGCTTCTGCTTGGTATAATTTGGGTAATGC
TTATTATAAACAAGGTGATTATCAAAAAGCTATTGAATATTATCAAAAAGCTTTGGAATTGGATCCAAATAATGCT
AAAGCTTGGTATAGAAGAGGTAATGCTTATTATAAACAAGGTGATTATCAAAAAGCTATTGAAGATTATCAAAAA
GCTTTGGAATTGGATCCAAATAATAGATCTAGATCTGCTGGTGGTGGTGGTTCTGGTGGTGGTGGTTCTGGTG
GTGGTGGTGCTTCTTCTTATTATCATCATCATCATCATTTGGAATCTACTTCTTTGTATAAAAAAGCTGGTTC
TGAATTTTTTAGAAGAGAAAGAAATAAAATGGCTGCTGCTAAATGTAGAAATAGAAGAAGAGAATTGACTGATAC
TTTGCAAGCTGAAACTGATCAATTGGAAGATGAAAAATCTGCTTTGCAAACTGAAATTGCTAATTTGTTGAAAGA
AAAAGAAAAATTGGAATTTATTTTGGCTGCTCATAGACCAGCTTGTAAAATTCCAGATGATTTGGGTTTTCCAGA
AGAAATGTCTTTGGAAGGTTCTGCTGGTTCTGCTGCTGGTTCTGGTGAATTTGGTTCTGCTGAAGCTGCTGCTA
AAGAAGCTGCTGCTAAAGCTGGTTCTGCTGGTTCTGCTGCTGGTTCTGGTGAATTTGGTTCTTCTTATTATCATC
ATCATCATCATTTGGAATCTACTTCTTTGTATAAAAAGCTGGTTCTGGTTCTCAAAAAGTTGAATCTTTGAA
ACAAAAAATTGAAGAATTGAAACAAAGAAAAGCTCAATTGAAAAATGATATTGCTAATTTGGAAAAAGAAATTGCT
TATGCTGAAACT
```

Mevalonate Kinase – Enzyme Linker – cTPR6 Spacer – ID Linker – ID9

```
ATGTCATTACCGTTCTTAACTTCTGCACCGGGAAAGGTTATTATTTTTGGTGAACACTCTGCTGTGTACAACAAG
CCTGCCGTCGCTGCTAGTGTGTCTGCGTTGAGAACCTACCTGCTAATAAGCGAGTCATCTGCACCAGATACTAT
TGAATTGGACTTCCCGGACATTAGCTTTAATCATAAGTGGTCCATCAATGATTTCAATGCCATCACCGAGGATCA
AGTAAACTCCCAAAAATTGGCCAAGGCTCAACAAGCCACCGATGGCTTGTCTCAGGAACTCGTTAGTCTTTTGG
ATCCGTTGTTAGCTCAACTATCCGAATCCTTCCACTACCATGCAGCGTTTTGTTTCCTGTATATGTTTGTTTGCCT
ATGCCCCCATGCCAAGAATATTAAGTTTTCTTTAAAGTCTACTTTACCCATCGGTGCTGGGTTGGGCTCAAGCG
CCTCTATTTCTGTATCACTGGCCTTAGCTATGGCCTACTTGGGGGGGTTAATAGGATCTAATGACTTGGAAAAG
CTGTCAGAAAACGATAAGCATATAGTGAATCAATGGGCCTTCATAGGTGAAAGTGTATTCACGGTACCCCTTC
AGGAATAGATAACGCTGTGGCCACTTATGGTAATGCCCTGCTATTTGAAAAAGACTCACATAATGGAACAATAAA
CACAAACAATTTTAAGTTCTTAGATGATTTCCCAGCCATTCCAATGATCCTAACCTATACTAGAATTCCAAGGTCT
ACAAAAGATCTTGTTGCTCGCGTTCGTGTGTTGGTCACCGAGAAATTTCCTGAAGTTATGAAGCCAATTCTAGAT
GCCATGGGTGAATGTGCCCTACAAGGCTTAGAGATCATGACTAAGTTAAGTAAATGTAAAGGCACCGATGACGA
GGCTGTAGAAACTAATAATGAACTGTATGAACAACTATTGGAATTGATAAGAATAAATCATGGACTGCTTGTCTC
AATCGGTGTTTCTCATCCTGGATTAGAACTTATTAAAAATCTGAGCGATGATTTGAGAATTGGCTCCACAAAACT
TACCGGTGCTGGTGGCGGCGGTTGCTCTTTGACTTTGTTACGAAGAGACATTACTCAAGAGCAAATTGACAGCT
TCAAAAAGAAATTGCAAGATGATTTTAGTTACGAGACATTTGAAACAGACTTGGGTGGGACTGGCTGCTGTTTG
TTAAGCGCAAAAAATTTGAATAAAGATCTTAAAATCAAATCCCTAGTATTCCAATTATTTGAAAATAAAACTACCA
CAAAGCAACAAATTGACGATCTATTATTGCCAGGAAACACGAATTTACCATGGACTTCATAAAAATTGTCTGGTG
GTGGTGGTTCTGGTGGTGGTGGTTCTGGTGGTGGTGGTTCTGCTGAAGCTTGGTATAATTTGGGTAATGCTTAT
TATAAACAAGGTGATTATCAAAAAGCTATTGAATATTATCAAAAAGCTTTGGAATTGGATCCAAATAATGCTGAAG
```

Figure 12B (continued)

```
CTTGGTATAATTTGGGTAATGCTTATTATAAACAAGGTGATTATCAAAAAGCTATTGAATATTATCAAAAAGCTTT
GGAATTGGATCCAAATAATGCTGAAGCTTGGTATAATTTGGGTAATGCTTATTATAAACAAGGTGATTATCAAAA
AGCTATTGAAGATTATCAAAAAGCTTTGGAATTGGATCCAAATAATTTGCAAGCTGAAGCTTGGAAAAATTTGGG
TAATGCTTATTATAAACAAGGTGATTATCAAAAAGCTATTGAATATTATCAAAAAGCTTTGGAATTGGATCCAAAT
AATGCTTCTGCTTGGTATAATTTGGGTAATGCTTATTATAAACAAGGTGATTATCAAAAAGCTATTGAATATTATC
AAAAAGCTTTGGAATTGGATCCAAATAATGCTAAAGCTTGGTATAGAAGAGGTAATGCTTATTATAAACAAGGTG
ATTATCAAAAAGCTATTGAAGATTATCAAAAAGCTTTGGAATTGGATCCAAATAATAGATCTAGATCTGCTGGTG
GTGGTGGTTCTGGTGGTGGTGGTTCTGGTGGTGGTGGTGCTTCTATGGAACCAGCTATGGAACCAGAAACTTT
GGAAGCTAGAATTAATAGAGCTACTAATCCATTGAATAAAGAATTGGATTGGGCTTCTATTAATGGTTTTTGTGA
ACAATTGAATGAAGATTTTGAAGGTCCACCATTGGCTACTAGATTGTTGGCTCATAAAATTCAATCTCCACAAGA
ATGGGAAGCTATTCAAGCTTTGACTGTTTTGGAAACTTGTATGAAATCTTGTGGTAAAAGATTTCATGATGAAGT
TGGTAAATTTAGATTTTTGAATGAATTGATTAAAGTTGTTTCTCCAAAATATTTGGGTTCTAGAACTTCTGAAAAA
GTTAAAAATAAAATTTTGGAATTGTTGTATTCTTGGACTGTTGGTTTGCCAGAAGAAGTTAAAATTGCTGAAGCTT
ATCAAATGTTGAAAAAACAAGGTATTGTTAAATCTGGTTCTGCTGGTTCTGCTGCTGGTTCTGGTGAATTTGGTT
CTGCTGAAGCTGCTGCTAAAGAAGCTGCTGCTAAAGCTGGTTCTGCTGGTTCTGCTGCTGGTTCTGGTGAATTT
GGTTCTGGTGCTATGGGTTCTATGGCTGAAGCTGAAGGTGAATCTTTGGAATCTTGGTTGAATAAAGCTACTAA
TCCATCTAATAGACAAGAAGATTGGGAATATATTATTGGTTTTTGTGATCAAATTAATAAAGAATTGGAAGGTCCA
CAAATTGCTGTTAGATTGTTGGCTCATAAAATTCAATCTCCACAAGAATGGGAAGCTTTGCAAGCTTTGACTGTT
TTGGAAGCTTGTATGAAAAATTGTGGTAGAAGATTTCATAATGAAGTTGGTAAATTTAGATTTTTGAATGAATTGA
TTAAAGTTGTTTCTCCAAAATATTTGGGTGATAGAGTTTCTGAAAAAGTTAAAACTAAAGTTATTGAATTGTTGTA
TTCTTGGACTATGGCTTTGCCAGAAGAAGCTAAAATTAAAGATGCTTATCATATGTTGAAAAGACAAGGTATTGT
TCAATCTGATCCACCAATTCCAGTTGATAGAACTTTGATTCCATCTCCACCACCAAGACCAAAAAAT
```

Phosphomevalonate Kinase – Enzyme Linker – cTPR6 Spacer – ID Linker – ID10

```
ATGTCAGAGTTGAGAGCCTTCAGTGCCCCAGGGAAAGCGTTACTAGCTGGTGGATATTTAGTTTTAGATACAAA
ATATGAAGCATTTGTAGTCGGATTATCGGCAAGAATGCATGCTGTAGCCCATCCTTACGGTTCATTGCAAGGGT
CTGATAAGTTTGAAGTGCGTGTGAAAAGTAAACAATTTAAAGATGGGGAGTGGCTGTACCATATAAGTCCTAAA
AGTGGCTTCATTCCTGTTTCGATAGGCGGATCTAAGAACCCTTTCATTGAAAAAGTTATCGCTAACGTATTTAGC
TACTTTAAACCTAACATGGACGACTACTGCAATAGAAACTTGTTCGTTATTGATATTTTCTCTGATGATGCCTACC
ATTCTCAGGAGGATAGCGTTACCGAACATCGTGGCAACAGAAGATTGAGTTTTCATTCGCACAGAATTGAAGAA
GTTCCCAAAACAGGGCTGGGCTCCTCGGCAGGTTTAGTCACAGTTTTAACTACAGCTTTGGCCTCCTTTTTTGT
ATCGGACCTGGAAAATAATGTAGACAAATATAGAGAAGTTATTCATAATTTAGCACAAGTTGCTCATTGTCAAGC
TCAGGGTAAAATTGGAAGCGGGTTTGATGTAGCGGCGGCAGCATATGGATCTATCAGATATAGAAGATTCCCA
CCCGCATTAATCTCTAATTTGCCAGATATTGGAAGTGCTACTTACGGCAGTAAACTGGCGCATTTGGTTGATGA
AGAAGACTGGAATATTACGATTAAAAGTAACCATTTACCTTCGGGATTAACTTTATGGATGGGCGATATTAAGAA
TGGTTCAGAAACAGTAAAACTGGTCCAGAAGGTAAAAAATTGGTATGATTCGCATATGCCAGAAAGCTTGAAAA
TATATACAGAACTCGATCATGCAAATTCTAGATTTATGGATGGACTATCTAAACTAGATCGCTTACACGAGACTC
ATGACGATTACAGCGATCAGATATTTGAGTCTCTTGAGAGGAATGACTGTACCTGTCAAAAGTATCCTGAAATCA
CAGAAGTTAGAGATGCAGTTGCCACAATTAGACGTTCCTTTAGAAAAATAACTAAAGAATCTGGTGCCGATATC
GAACCTCCCGTACAAACTAGCTTATTGGATGATTGCCAGACCTTAAAAGGAGTTCTTACTTGCTTAATACCTGGT
GCTGGTGGTTATGACGCCATTGCAGTGATTACTAAGCAAGATGTTGATCTTAGGGCTCAAACCGCTAATGACAA
AAGATTTTCTAAGGTTCAATGGCTGGATGTAACTCAGGCTGACTGGGGTGTTAGGAAAGAAAAAGATCCGGAAA
CTTATCTTGATAAATAAAAATTGTCTGGTGGTGGTGGTTCTGGTGGTGGTGGTTCTGGTGGTGGTGGTTCTGCT
GAAGCTTGGTATAATTTGGGTAATGCTTATTATAAACAAGGTGATTATCAAAAAGCTATTGAATATTATCAAAAAG
CTTTGGAATTGGATCCAAATAATGCTGAAGCTTGGTATAATTTGGGTAATGCTTATTATAAACAAGGTGATTATCA
AAAAGCTATTGAATATTATCAAAAAGCTTTGGAATTGGATCCAAATAATGCTGAAGCTTGGTATAATTTGGGTAAT
GCTTATTATAAACAAGGTGATTATCAAAAAGCTATTGAAGATTATCAAAAAGCTTTGGAATTGGATCCAAATAATT
TGCAAGCTGAAGCTTGGAAAAATTTGGGTAATGCTTATTATAAACAAGGTGATTATCAAAAAGCTATTGAATTA
TCAAAAAGCTTTGGAATTGGATCCAAATAATGCTTCTGCTTGGTATAATTTGGGTAATGCTTATTATAAACAAGGT
GATTATCAAAAAGCTATTGAATATTATCAAAAAGCTTTGGAATTGGATCCAAATAATGCTAAAGCTTGGTATAGAA
GAGGTAATGCTTATTATAAACAAGGTGATTATCAAAAAGCTATTGAAGATTATCAAAAAGCTTTGGAATTGGATC
CAAATAATAGATCTAGATCTGCTGGTGGTGGTGGTTCTGGTGGTGGTGGTTCTGGTGGTGGTGGTGCTTCTTCT
```

Figure 12B (continued)

TATTATCATCATCATCATCATCATTTGGAATCTACTTCTTTGTATAAAAAAGCTGGTTCTGGTTCTCAAAAAGTTG
AAGAATTGAAAAATAAAATTGCTGAATTGGAAAATAGAAATGCTGTTAAAAAAAATAGAGTTGCTCATTTGAAACA
AGAAATTGCTTATTTGAAAGATGAATTGGCTGCTCATGAATTTGAAGGTTCTGCTGGTTCTGCTGCTGGTTCTGG
TGAATTTGGTTCTGCTGAAGCTGCTGCTAAAGAAGCTGCTGCTAAAGCTGGTTCTGCTGGTTCTGCTGCTGGTT
CTGGTGAATTTGGTTCTTCTTATTATCATCATCATCATCATTTGGAATCTACTTCTTTGTATAAAAAAGCTGG
TTCTGGTTCTTTTGAAAATGTTACTCATGAATTTATTTTGGCTACTTTGGAAAATGAAAATGCTAAATTGAGAAGA
TTGGAAGCTAAATTGGAAAGAGAATTGGCTAGATTGAGAAATGAAGTTGCTTGGTTG

Diphosphomevalonate Decarboxylase – Enzyme Linker – cTPR6 Spacer – ID Linker – ID11

ATGACCGTTTACACAGCATCCGTTACCGCACCCGTCAACATCGCAACCCTTAAGTATTGGGGGAAAAGGGACA
CGAAGTTGAATCTGCCCACCAATTCGTCCATATCAGTGACTTTATCGCAAGATGACCTCAGAACGTTGACCTCT
GCGGCTACTGCACCTGAGTTTGAACGCGACACTTTGTGGTTAAATGGAGAACCACACAGCATCGACAATGAAA
GAACTCAAAATTGTCTGCGCGACCTACGCCAATTAAGAAAGGAAATGGAATCGAAGGACGCCTCATTGCCCAC
ATTATCTCAATGGAAACTCCACATTGTCTCCGAAAATAACTTTCCTACAGCAGCTGGTTTAGCTTCCTCCGCTGC
TGGCTTTGCTGCATTGGTCTCTGCAATTGCTAAGTTATACCAATTACCACAGTCAACTTCAGAAATATCTAGAAT
AGCAAGAAAGGGGTCTGGTTCAGCTTGTAGATCGTTGTTTGGCGGATACGTGGCCTGGGAAATGGGAAAAGCT
GAAGATGGTCATGATTCCATGGCAGTACAAATCGCAGACAGCTCTGACTGGCCTCAGATGAAAGCTTGTGTCCT
AGTTGTCAGCGATATTAAAAAGGATGTGAGTTCCACTCAGGGTATGCAATTGACCGTGGCAACCTCCGAACTAT
TTAAAGAAAGAATTGAACATGTCGTACCAAAGAGATTTGAAGTCATGCGTAAAGCCATTGTTGAAAAAGATTTCG
CCACCTTTGCAAAGGAAACAATGATGGATTCCAACTCTTTCCATGCCACATGTTTGGACTCTTTCCCTCCAATAT
TCTACATGAATGACACTTCCAAGCGTATCATCAGTTGGTGCCACACCATTAATCAGTTTTACGGAGAAACAATCG
TTGCATACACGTTTGATGCAGGTCCAAATGCTGTGTTGTACTACTTAGCTGAAAATGAGTCGAAACTCTTTGCAT
TTATCTATAAATTGTTTGGCTCTGTTCCTGGATGGGACAAGAAATTTACTACTGAGCAGCTTGAGGCTTTCAACC
ATCAATTTGAATCATCTAACTTTACTGCACGTGAATTGGATCTTGAGTTGCAAAAGGATGTTGCCAGAGTGATTT
TAACTCAAGTCGGTTCAGGCCCACAAGAAACAAACGAATCTTTGATTGACGCAAAGACTGGTCTACCAAAGGAA
TAAAAATTGTCTGGTGGTGGTGGTTCTGGTGGTGGTGGTTCTGGTGGTGGTGGTTCTGCTGAAGCTTGGTATA
ATTTGGGTAATGCTTATTATAAACAAGGTGATTATCAAAAAGCTATTGAATATTATCAAAAAGCTTTGGAATTGGA
TCCAAATAATGCTGAAGCTTGGTATAATTTGGGTAATGCTTATTATAAACAAGGTGATTATCAAAAGCTATTGAA
TATTATCAAAAGCTTTGGAATTGGATCCAAATAATGCTGAAGCTTGGTATAATTTGGGTAATGCTTATTATAAAC
AAGGTGATTATCAAAAAGCTATTGAAGATTATCAAAAAGCTTTGGAATTGGATCCAAATAATTTGCAAGCTGAAG
CTTGGAAAAATTTGGGTAATGCTTATTATAAACAAGGTGATTATCAAAAAGCTATTGAATATTATCAAAAAGCTTT
GGAATTGGATCCAAATAATGCTTCTGCTTGGTATAATTTGGGTAATGCTTATTATAAACAAGGTGATTATCAAAA
GCTATTGAATATTATCAAAAAGCTTTGGAATTGGATCCAAATAATGCTAAAGCTTGGTATAGAAGAGGTAATGCT
TATTATAAACAAGGTGATTATCAAAAAGCTATTGAAGATTATCAAAAAGCTTTGGAATTGGATCCAAATAATAGAT
CTAGATCTGCTGGTGGTGGTGGTTCTGGTGGTGGTGGTTCTGGTGGTGGTGGTGCTTCTGCTATGGCTGATTT
GGAACAAAAAGTTTTGGAAATGGAAGCTTCTACTTATGATGGTGTTTTTATTTGGAAAATTTCTGATTTTCCAAGA
AAAAGACAAGAAGCTGTTGCTGGTAGAATTCCAGCTATTTTTTCTCCAGCTTTTTATACTTCTAGATATGGTTATA
AAATGTGTTTGAGAATTTATTTGAATGGTGATGGTACTGGTAGAGGTACTCATTTGTCTTTGTTTTTGTTGTTAT
GAAAGGTCCAAATGATGCTTTGTTGAGATGGCCATTTAATCAAAAAGTTACTTTGATGTTGTTGGATCAAAATAA
TAGAGAACATGTTATTGATGCTTTTAGACCAGATGTTACTTCTTCTTTTCAAAGACCAGTTAATGATATGAAT
ATTGCTTCTGGTTGTCCATTGTTTTGTCCAGTTTCTAAAATGGAAGCTAAAAATTCTTATGTTAGAGATGATGCTA
TTTTTATTAAAGCTATTGTTGATTTGACTGGTTTGGGTTCTGCTGGTTCTGCTGCTGGTTCTGGTGAATTTGGTT
CTGCTGAAGCTGCTGCTAAAGAAGCTGCTGCTAAAGCTGGTTCTGCTGGTTCTGCTGCTGGTTCTGGTGAATTT
GGTTCTGCTTCTATTAAATTGCAATCTTCTGATGGTGAAATTTTTGAAGTTGATGTTGAAATTGCTAAACAATCTG
TTACTATTAAAACTATGTTGGAAGATTTGGGTATGGATGATGAAGGTGATGATGATCCAGTTCCATTGCCAAATG
TTAATGCTGCTATTTTGAAAAAAGTTATTCAATGGTGTACTCATCATAAAGATGATCCACCACCACCAGAAGATG
ATGAAAATAAAGAAAAAGAACTGATGATATTCCAGTTTGGGATCAAGAATTTTTGAAAGTTGATCAAGGTACTTT
GTTTGAATTGATTTTGGCTGCTAATTATTTGGATATTAAAGGTTTGTTGGATGTTACTTGTAAAACTGTTGCTAAT
ATGATTAAAGGTAAAACTCCAGAAGAAATTAGAAAAACTTTTAATATTAAAAATGATTTTACTGAAGAAGAAGAAG
CTCAAGTTAGAAAAGAAAATCAATGGTGT

Figure 12B (continued)

Isopentenyl-Diphosphate Delta-Isomerase – Enzyme Linker – cTPR6 Spacer – ID Linker – ID12

ATGACTGCCGACAACAATAGTATGCCCCATGGTGCAGTATCTAGTTACGCCAAATTAGTGCAAAACCAAACACC
TGAAGACATTTTGGAAGAGTTTCCTGAAATTATTCCATTACAACAAAGACCTAATACCCGATCTAGTGAGACGTC
AAATGACGAAAGCGGAGAAACATGTTTTTCTGGTCATGATGAGGAGCAAATTAAGTTAATGAATGAAAATTGTAT
TGTTTTGGATTGGGACGATAATGCTATTGGTGCCGGTACCAAGAAAGTTTGTCATTTAATGGAAAATATTGAAAA
GGGTTTACTACATCGTGCATTCTCCGTCTTTATTTTCAATGAACAAGGTGAATTACTTTTACAACAAAGAGCCAC
TGAAAAAAATAACTTTCCCTGATCTTTGGACTAACACATGCTGCTCTCATCCACTATGTATTGATGACGAATTAGG
TTTGAAGGGTAAGCTAGACGATAAGATTAAGGGCGCTATTACTGCGGCGGTGAGAAAACTAGATCATGAATTAG
GTATTCCAGAAGATGAAACTAAGACAAGGGGTAAGTTTCACTTTTTAAACAGAATCCATTACATGGCACCAAGCA
ATGAACCATGGGGTGAACATGAAATTGATTACATCCTATTTTATAAGATCAACGCTAAAGAAAACTTGACTGTCA
ACCCAAACGTCAATGAAGTTAGAGACTTCAAATGGGTTTCACCAAATGATTTGAAAACTATGTTTGCTGACCCAA
GTTACAAGTTTACGCCTTGGTTTAAGATTATTTGCGAGAATTACTTATTCAACTGGTGGGAGCAATTAGATGACC
TTTCTGAAGTGGAAAATGACAGGCAAATTCATAGAATGCTATAAAAATTGTCTGGTGGTGGTGGTTCTGGTGGT
GGTGGTTCTGGTGGTGGTGGTTCTGCTGAAGCTTGGTATAATTTGGGTAATGCTTATTATAAACAAGGTGATTAT
CAAAAAGCTATTGAATATTATCAAAAAGCTTTGGAATTGGATCCAAATAATGCTGAAGCTTGGTATAATTTGGGT
AATGCTTATTATAAACAAGGTGATTATCAAAAAGCTATTGAATATTATCAAAAAGCTTTGGAATTGGATCCAAATA
ATGCTGAAGCTTGGTATAATTTGGGTAATGCTTATTATAAACAAGGTGATTATCAAAAAGCTATTGAAGATTATCA
AAAAGCTTTGGAATTGGATCCAAATAATTTGCAAGCTGAAGCTTGGAAAAATTTGGGTAATGCTTATTATAAACA
AGGTGATTATCAAAAAGCTATTGAATATTATCAAAAAGCTTTGGAATTGGATCCAAATAATGCTTCTGCTTGGTAT
AATTTGGGTAATGCTTATTATAAACAAGGTGATTATCAAAAAGCTATTGAATATTATCAAAAAGCTTTGGAATTGG
ATCCAAATAATGCTAAAGCTTGGTATAGAAGAGGTAATGCTTATTATAAACAAGGTGATTATCAAAAAGCTATTG
AAGATTATCAAAAAGCTTTGGAATTGGATCCAAATAATAGATCTAGATCTGCTGGTGGTGGTGGTTCTGGTGGT
GGTGGTTCTGGTGGTGGTGGTGCTTCTTCTTATTATCATCATCATCATCATCATTTGGAATCTACTTCTTTGTATA
AAAAAGCTGGTTCTGGTTCTAATACTGTTAAAGAATTGAAAAATTATATTCAAGAATTGGAAGAAAGAAATGCTG
AATTGAAAAATTTGAAAGAACATTTGAAATTTGCTAAAGCTGAATTGGAATTTGAATTGGCTGCTCATAAATTTGA
AGGTTCTGCTGGTTCTGCTGCTGGTTCTGGTGAATTTGGTTCTGCTGAAGCTGCTGCTAAAGAAGCTGCTGCTA
AAGCTGGTTCTGCTGGTTCTGCTGCTGGTTCTGGTGAATTTGGTTCTTCTTATTATCATCATCATCATCATTT
GGAATCTACTTCTTTGTATAAAAAAGCTGGTTCTGGTTCTCAAAAAGTTGCTCAATTGAAAAATAGAGTTGCTTAT
AAATTGAAAGAAAATGCTAAATTGGAAAATATTGTTGCTAGATTGGAAAATGATAATGCTAATTTGGAAAAAGATA
TTGCTAATTTGGAAAAAGATATTGCTAATTTGGAAAGAGATGTTGCTAGA

Geranyl-Diphosphate Synthase (ERG20$^{WW}$) – Enzyme Linker – cTPR6 Spacer – ID Linker – ID13

ATGGCTTCAGAAAAGGAAATAAGAAGAGAAAGATTCTTGAACGTATTCCCAAAGTTAGTTGAAGAATTGAACGCT
AGTTTGTTAGCTTATGGTATGCCTAAAGAAGCCTGCGATTGGTATGCTCACTCTTTAAACTACAATACTCCAGGT
GGTAAATTGAATAGAGGTTTGAGTGTAGTTGATACTTATGCTATCTTGTCTAACAAAACCGTTGAACAATTAGGT
CAAGAAGAATACGAAAAGGTCGCTATCTTGGGTTGGTGTATTGAATTGTTGCAAGCATACTTTTTGGTTGCCGAT
GACATGATGGATAAGTCTATAACAAGAAGAGGTCAACCATGCTGGTACAAAGTTCCAGAAGTTGGTGAAATAGC
CATAAATGATGCTTTTATGTTGGAAGCCGCTATCTATAAATTGTTGAAGTCACATTTCAGAAACGAAAAGTACTA
CATCGATATTACCGAATTATTCCACGAAGTTACTTTCCAAACAGAATTGGGTCAATTGATGGATTTGATAACTGC
ACCTGAAGATAAAGTTGACTTGTCAAAGTTTTCCTTGAAGAAACATTCATTCATCGTCACCTTTGAAACTGCTTAT
TACTCCTTCTATTTGCCAGTCGCCTTGGCTATGTACGTAGCTGGTATTACTGATGAAAAAGACTTGAAGCAAGCA
AGAGATGTTTTGATACCCTTTGGGTGAATACTTCCAAATCCAAGATGACTACTTAGACTGTTTCGGTACTCCAGAA
CAAATAGGTAAAATCGGTACAGATATTCAAGACAATAAGTGCAGTTGGGTTATTAACAAGGCTTTGGAATTAGCA
TCTGCCGAACAAAGAAAGACTTTGGATGAAAACTACGGTAAAAAGGACTCAGTTGCTGAAGCAAAGTGTAAGAA
AATTTTTAATGATTTGAAGATTGAACAATTGTACCATGAATACGAAGAATCCATCGCTAAAGACTTAAAGGCAAA
GATTAGTCAAGTTGATGAATCAAGAGGTTTTAAAGCCGACGTTTTGACAGCTTTCTTGAATAAGGTCTACAAGAG
ATCAAAGTAGAAATTGTCTGGTGGTGGTGGTTCTGGTGGTGGTGGTTCTGGTGGTGGTTCTGCTGAAGCT
TGGTATAATTTGGGTAATGCTTATTATAAACAAGGTGATTATCAAAAAGCTATTGAATATTATCAAAAAGCTTTGG
AATTGGATCCAAATAATGCTGAAGCTTGGTATAATTTGGGTAATGCTTATTATAAACAAGGTGATTATCAAAAAG
CTATTGAATATTATCAAAAAGCTTTGGAATTGGATCCAAATAATGCTGAAGCTTGGTATAATTTGGGTAATGCTTA

Figure 12B (continued)

```
TTATAAACAAGGTGATTATCAAAAAGCTATTGAAGATTATCAAAAAGCTTTGGAATTGGATCCAAATAATTTGCAA
GCTGAAGCTTGGAAAAATTTGGGTAATGCTTATTATAAACAAGGTGATTATCAAAAAGCTATTGAATATTATCAAA
AAGCTTTGGAATTGGATCCAAATAATGCTTCTGCTTGGTATAATTTGGGTAATGCTTATTATAAACAAGGTGATTA
TCAAAAAGCTATTGAATATTATCAAAAAGCTTTGGAATTGGATCCAAATAATGCTAAAGCTTGGTATAGAAGAGG
TAATGCTTATTATAAACAAGGTGATTATCAAAAAGCTATTGAAGATTATCAAAAAGCTTTGGAATTGGATCCAAAT
AATAGATCTAGATCTGCTGGTGGTGGTGGTTCTGGTGGTGGTGGTTCTGGTGGTGGTGCTTCTTTGTGTA
CTATGAAAAAGGTCCATCTGGTTATGGTTTTAATTTGCATTCTGATAAATCTAAACCAGGTCAATTTATTAGATC
TGTTGATCCAGATTCTCCAGCTGAAGCTTCTGGTTTGAGAGCTCAAGATAGAATTGTTGAAGTTAATGGTGTTTG
TATGGAAGGTAAACAACATGGTGATGTTGTTTCTGCTATTAGAGCTGGTGGTGATGAAACTAAATTGTTGGTTGT
TGATAGAGAAGGTTCTGCTGGTTCTGCTGCTGGTTCTGGTGAATTTGGTTCTGCTGAAGCTGCTGCTAAAGAAG
CTGCTGCTAAAGCTGGTTCTGCTGGTTCTGCTGCTGGTTCTGGTGAATTTGGTTCTTCTTCTGGTGCTATTATTT
ATACTGTTGAATTGAAAAGATATGGTGGTCCATTGGGTATTACTATTTCTGGTACTGAAGAACCATTTGATCCAA
TTATTATTTCTTCTTTGACTAAAGGTGGTTTGGCTGAAAGAACTGGTGCTATTCATATTGGTGATAGAATTTTGGC
TATTAATTCTTCTTCTTTGAAAGGTAAACCATTGTCTGAAGCTATTCATTTGTTGCAAATGGCTGGTGAAACTGTT
ACTTTGAAAATTAAAAAACAAACTGATGCTCAACCAGCTTCTTCT
```

Olivetol Synthase – Enzyme Linker – cTPR6 Spacer – ID Linker – ID14

```
ATGAATCATTTGAGAGCTGAAGGTCCAGCTTCTGTTTTGGCTATTGGTACTGCTAATCCAGAAAATATTTTGTTG
CAAGATGAATTTCCAGATTATTATTTTAGAGTTACTAAATCTGAACATATGACTCAATTGAAAGAAAAATTTAGAA
AAATTTGTGATAAATCTATGATTAGAAAAAGAAATTGTTTTTTGAATGAAGAACATTTGAAACAAAATCCAAGATT
GGTTGAACATGAAATGCAAACTTTGGATGCTAGACAAGATATGTTGGTTGTTGAAGTTCCAAAATTGGGTAAAGA
TGCTTGTGCTAAAGCTATTAAAGAATGGGGTCAACCAAAATCTAAAATTACTCATTTGATTTTTACTTCTGCTTCT
ACTACTGATATGCCAGGTGCTGATTATCATTGTGCTAAATTGTTGGGTTTGTCTCCATCTGTTAAAGAGTTATG
ATGTATCAATTGGGTTGTTATGGTGGTGGTACTGTTTTGAGAATTGCTAAAGATATTGCTGAAAATAATAAAGGT
GCTAGAGTTTTGGCTGTTTGTTGTGATATTATGGCTTGTTTGTTTAGAGGTCCATCTGAATCTGATTTGGAATTG
TTGGTTGGTCAAGCTATTTTTGGTGATGGTGCTGCTGCTGTTATTGTTGGTGCTGAACCAGATGAATCTGTTGG
TGAAAGACCAATTTTTGAATTGGTTTCTACTGGTCAAACTATTTTGCCAAATTCTGAAGGTACTATTGGTGGTCAT
ATTAGAGAAGCTGGTTTGATTTTTGATTTGCATAAAGATGTTCCAATGTTGATTTCTAATAATATTGAAAAATGTTT
GATTGAAGCTTTTACTCCAATTGGTATTTCTGATTGGAATTCTATTTTTTGGATTACTCATCCAGGTGGTAAAGCT
ATTTTGGATAAAGTTGAAGAAAAATTGCATTTGAAATCTGATAAATTTGTTGATTCTAGACATGTTTTGTCTGAAC
ATGGTAATATGTCTTCTTCTACTGTTTTGTTTGTTATGGATGAATTGAGAAAAAGATCTTTGGAAGAAGGTAAATC
TACTACTGGTGATGGTTTTGAATGGGGTGTTTTGTTTGGTTTTGGTCCAGGTTTGACTGTTGAAAGAGTTGTTGT
TAGATCTGTTCCAATTAAATATAAATTGTCTGGTGGTGGTGGTTCTGGTGGTGGTGGTTCTGGTGGTGGTGGTT
CTGCTGAAGCTTGGTATAATTTGGGTAATGCTTATTATAAACAAGGTGATTATCAAAAAGCTATTGAATATTATCA
AAAAGCTTTGGAATTGGATCCAAATAATGCTGAAGCTTGGTATAATTTGGGTAATGCTTATTATAAACAAGGTGA
TTATCAAAAAGCTATTGAATATTATCAAAAAGCTTTGGAATTGGATCCAAATAATGCTGAAGCTTGGTATAATTTG
GGTAATGCTTATTATAAACAAGGTGATTATCAAAAAGCTATTGAAGATTATCAAAAAGCTTTGGAATTGGATCCAA
ATAATTTGCAAGCTGAAGCTTGGAAAAATTTGGGTAATGCTTATTATAAACAAGGTGATTATCAAAAAGCTATTGA
ATATTATCAAAAAGCTTTGGAATTGGATCCAAATAATGCTTCTGCTTGGTATAATTTGGGTAATGCTTATTATAAA
CAAGGTGATTATCAAAAAGCTATTGAATATTATCAAAAAGCTTTGGAATTGGATCCAAATAATGCTAAAGCTTGG
TATAGAAGAGGTAATGCTTATTATAAACAAGGTGATTATCAAAAAGCTATTGAAGATTATCAAAAAGCTTTGGAAT
TGGATCCAAATAATAGATCTAGATCTGCTGGTGGTGGTGGTTCTGGTGGTGGTGGTTCTGGTGGTGGTGGTGC
TTCTGGTAATAATTTGGAAACTTATGAATGGTATAATAAATCTATTTCTAGAGATAAAGCTGAAAAATTGTTGTTG
GATACTGGTAAAGAAGGTGCTTTTATGGTTAGAGATTCTAGAACTCCAGGTACTTATACTGTTTCTGTTTTTACTA
AAGCTATTATTTCTGAAAATCCATGTATTAAACATTATCATATTAAAGAAACTAATGATTCTCCAAAAAGATATTAT
GTTGCTGAAAAATATGTTTTTGATTCTATTCCATTGTTGATTCAATATCATCAATATAATGGTGGTGGTTTGGTTA
CTAGATTGAGATATCCAGTTTGTGGTGGTTCTGCTGGTTCTGCTGCTGGTTCTGGTGAATTTGGTTCTGCTGAA
GCTGCTGCTAAAGAAGCTGCTGCTAAAGCTGGTTCTGCTGGTTCTGCTGCTGGTTCTGGTGAATTTGGTTCTGG
TTCTCATCCATGGTTTTTTGGTAAAATTCCAAGAGCTAAAGCTGAAGAAATGTTGTCTAAACAAAGACATGATGG
TGCTTTTTTGATTAGAGAATCTGAATCTGCTCCAGGTGATTTTCTTTGTCTGTTAAATTTGGTAATGATGTTCAA
```

Figure 12B (continued)

```
CATTTTAAAGTTTTGAGAGATGGTGCTGGTAAATATTTTTGTGGGTTGTTAAATTTAATTCTTTGAATGAATTGG
TTGATTATCATAGATCTACTTCTGTTTCTAGAAATCAACAAATTTTTTTGAGAGATATTGAACAAGTTCCACAACA
ACCAACT
```

Olivetolic Acid Cyclase – Enzyme Linker – cTPR6 Spacer – ID Linker – ID15

```
ATGGCTGTTAAACATTTGATTGTTTTGAAATTTAAAGATGAAATTACTGAAGCTCAAAAAGAAGAATTTTTTAAAA
CTTATGTTAATTTGGTTAATATTATTCCAGCTATGAAAGATGTTTATTGGGGTAAAGATGTTACTCAAAAAAATAA
AGAAGAAGGTTATACTCATATTGTTGAAGTTACTTTTGAATCTGTTGAAACTATTCAAGATTATATTATTCATCCA
GCTCATGTTGGTTTTGGTGATGTTTATAGATCTTTTTGGGAAAAATTGTTGATTTTTGATTATACTCCAAGAAAAA
AATTGTCTGGTGGTGGTGGTTCTGGTGGTGGTGGTTCTGGTGGTGGTGGTTCTGCTGAAGCTTGGTATAATTT
GGGTAATGCTTATTATAAACAAGGTGATTATCAAAAAGCTATTGAATATTATCAAAAAGCTTTGGAATTGGATCCA
AATAATGCTGAAGCTTGGTATAATTTGGGTAATGCTTATTATAAACAAGGTGATTATCAAAAAGCTATTGAATATT
ATCAAAAAGCTTTGGAATTGGATCCAAATAATGCTGAAGCTTGGTATAATTTGGGTAATGCTTATTATAAACAAG
GTGATTATCAAAAAGCTATTGAAGATTATCAAAAAGCTTTGGAATTGGATCCAAATAATTTGCAAGCTGAAGCTT
GGAAAAATTTGGGTAATGCTTATTATAAACAAGGTGATTATCAAAAAGCTATTGAATATTATCAAAAAGCTTTGGA
ATTGGATCCAAATAATGCTTCTGCTTGGTATAATTTGGGTAATGCTTATTATAAACAAGGTGATTATCAAAAAGCT
ATTGAATATTATCAAAAAGCTTTGGAATTGGATCCAAATAATGCTAAAGCTTGGTATAGAAGAGGTAATGCTTATT
ATAAACAAGGTGATTATCAAAAAGCTATTGAAGATTATCAAAAAGCTTTGGAATTGGATCCAAATAATAGATCTAG
ATCTGCTGGTGGTGGTGGTTCTGGTGGTGGTGGTTCTGGTGGTGGTGGTGCTTCTGGTCAAGATAGATCTGAA
GCTACTTTGATTAAAAGATTTAAAGGTGAAGGTGTTAGATATAAAGCTAAATTGATTGGTATTGATGAAGTTTCTG
CTGCTAGAGGTGATAAATTGTGTCAAGATTCTATGATGAAATTGAAAGGTGTTGTTGCTGGTGCTAGATCTAAAG
GTGAACATAAACAAAAAATTTTTTTGACTATTTCTTTGGTGGTATTAAAATTTTTGATGAAAAAACTGGTGCTTTG
CAACATCATCATGCTGTTCATGAAATTTCTTATATTGCTAAAGATATTACTGATCATAGAGCTTTTGGTTATGTTT
GTGGTAAAGAAGGTAATCATAGATTTGTTGCTATTAAAACTGCTCAAGCTGCTGAACCAGTTATTTTGGATTTGA
GAGATTTGTTTCAATTGATTTATGAATTGAAACAAAGAGAAGAATTGGAAAAAAAAGCTGGTTCTGCTGGTTCTG
CTGCTGGTTCTGGTGAATTTGGTTCTGCTGAAGCTGCTGCTAAAGAAGCTGCTGCTAAAGCTGGTTCTGCTGGT
TCTGCTGCTGGTTCTGGTGAATTTGGTTCTGGTTCTCATATGGGTTCTCAATTTTGGGTTACTTCTCAAAAAACT
GAAGCTTCTGAAAGATGTGGTTTGCAAGGTTCTTATATTTTGAGAGTTGAAGCTGAAAAATTGACTTTGTTGACT
TTGGGTGCTCAATCTCAAATTTTGGAACCATTGTTGTTTTGGCCATATACTTTGTTGAGAAGATATGGTAGAGAT
AAAGTTATGTTTTCTTTTGAAGCTGGTAGAAGATGTCCATCTGGTCCAGGTACTTTTACTTTTCAAACTTCTCAAG
GTAATGATATTTTTCAAGCTGTTGAAGCTGCTATTCAACAACAAAAAGCTCAAGGTAAAGTTGGTCAAGCTCAAG
ATATTTTGAGATTGGAACATCATCATCATCATCAT
```

CBGA Synthase – Enzyme Linker – cTPR6 Spacer – ID Linker – ID16

```
ATGGGTTTGTCTTCTGTTTGTACTTTTTCTTTTCAAACTAATTATCATACTTTGTTGAATCCACATAATAATAATCC
AAAAACTTCTTTGTTGTGTTATAGACATCCAAAAACTCCAATTAAATATTCTTATAATAATTTTCCATCTAAACATT
GTTCTACTAAATCTTTTCATTTGCAAAATAAATGTTCTGAATCTTTGTCTATTGCTAAAAATTCTATTAGAGCTGCT
ACTACTAATCAAACTGAACCACCAGAATCTGATAATCATTCTGTTGCTACTAAAATTTTGAATTTTGGTAAAGCTT
GTTGGAAATTGCAAAGACCATATACTATTATTGCTTTTACTTCTTGTGCTTGTGGTTTGTTTGGTAAAGAATTGTT
GCATAATACTAATTTGATTTCTTGGTCTTTGATGTTTAAAGCTTTTTTTTTTTGGTTGCTATTTTGTGTATTGCTT
CTTTTACTACTACTATTAATCAAATTTATGATTTGCATATTGATAGAATTAATAAACCAGATTTGCCATTGGCTTCT
GGTGAAATTTCTGTTAATACTGCTTGGATTATGTCTATTATTGTTGCTTTGTTTGGTTTGATTATTACTATTAAAAT
GAAAGGTGGTCCATTGTATATTTTTGGTTATTGTTTTGGTATTTTTGGTGGTATTGTTTATTCTGTTCCACCATTTA
GATGGAAACAAAATCCATCTACTGCTTTTTTGTTGAATTTTTGGCTCATATTATTACTAATTTTACTTTTTATTAT
GCTTCTAGAGCTGCTTTGGGTTTGCCATTTGAATTGAGACCATCTTTTACTTTTTTGTTGGCTTTTATGAAATCTA
TGGGTTCTGCTTTGGCTTTGATTAAAGATGCTTCTGATGTTGAAGGTGATACTAAATTTGGTATTTCTACTTTGG
CTTCTAAATATGGTTCTAGAAATTTGACTTTGTTTTGTTCTGGTATTGTTTTGTTGTCTTATGTTGCTGCTATTTTG
GCTGGTATTATTTGGCCACAAGCTTTTAATTCTAATGTTATGTTGTTGTCTCATGCTATTTTGGCTTTTTGGTTGA
```

Figure 12B (continued)

```
TTTTGCAAACTAGAGATTTTGCTTTGACTAATTATGATCCAGAAGCTGGTAGAAGATTTTATGAATTTATGTGGAA
ATTGTATTATGCTGAATATTTGGTTTATGTTTTTATTAAATTGTCTGGTGGTGGTGGTTCTGGTGGTGGTGGTTCT
GGTGGTGGTGGTTCTGCTGAAGCTTGGTATAATTTGGGTAATGCTTATTATAAACAAGGTGATTATCAAAAAGCT
ATTGAATATTATCAAAAAGCTTTGGAATTGGATCCAAATAATGCTGAAGCTTGGTATAATTTGGGTAATGCTTATT
ATAAACAAGGTGATTATCAAAAAGCTATTGAATATTATCAAAAAGCTTTGGAATTGGATCCAAATAATGCTGAAG
CTTGGTATAATTTGGGTAATGCTTATTATAAACAAGGTGATTATCAAAAAGCTATTGAAGATTATCAAAAAGCTTT
GGAATTGGATCCAAATAATTTGCAAGCTGAAGCTTGGAAAAATTTGGGTAATGCTTATTATAAACAAGGTGATTA
TCAAAAAGCTATTGAATATTATCAAAAAGCTTTGGAATTGGATCCAAATAATGCTTCTGCTTGGTATAATTTGGGT
AATGCTTATTATAAACAAGGTGATTATCAAAAAGCTATTGAATATTATCAAAAAGCTTTGGAATTGGATCCAAATA
ATGCTAAAGCTTGGTATAGAAGAGGTAATGCTTATTATAAACAAGGTGATTATCAAAAAGCTATTGAAGATTATC
AAAAAGCTTTGGAATTGGATCCAAATAATAGATCTAGATCTGCTGGTGGTGGTGGTTCTGGTGGTGGTGGTTCT
GGTGGTGGTGGTGCTTCTGCTGAATATGTTAGAGCTTTGTTTGATTTTAATGGTAATGATGAAGAAGATTTGCCA
TTTAAAAAAGGTGATATTTTGAGAATTAGAGATAAACCAGAAGAACAATGGTGGAATGCTGAAGATTCTGAAGGT
AAAAGAGGTATGATTCCAGTTCCATATGTTGAAAAATATGGTTCTGCTGGTTCTGCTGCTGGTTCTGGTGAATTT
GGTTCTGCTGAAGCTGCTGCTAAAGAAGCTGCTGCTAAAGCTGGTTCTGCTGGTTCTGCTGCTGGTTCTGGTG
AATTTGGTTCTTTGATTAAACATATGAGAGCTGAAGCTTTGTTTGATTTTACTGGTAATTCTAAATTGGAATTGAA
TTTTAAAGCTGGTGATGTTATTTTTTTGTTGTCTAGAATTAATAAAGATTGGTTGGAAGGTACTGTTAGAGGTGCT
ACTGGTATTTTTCCATTGTCTTTTGTTAAAATTTTGAAA
```

Acetyl-CoA Carboxylase – Enzyme Linker – cTPR6 Spacer – ID Linker – ID17

```
ATGAGCGAAGAAAGCTTATTCGAGTCTTCTCCACAGAAGATGGAGTACGAAATTACAAACTACTCAGAAAGACA
TACAGAACTTCCAGGTCATTTCATTGGCCTCAATACAGTAGATAAACTAGAGGAGTCCCCGTTAAGGGACTTTG
TTAAGAGTCACGGTGGTCACACGGTCATATCCAAGATCCTGATAGCAAATAATGGTATTGCCGCCGTGAAAGAA
ATTAGATCCGTCAGAAAATGGGCATACGAGACGTTCGGCGATGACAGAACCGTCCAATTCGTCGCCATGGCCA
CCCCAGAAGATCTGGAGGCCAACGCAGAATATATCCGTATGGCCGATCAATACATTGAAGTGCCAGGTGGTAC
TAATAATAACAACTACGCTAACGTAGACTTGATCGTAGACATCGCCGAAAGAGCAGACGTAGACGCCGTATGG
GCTGGCTGGGGTCACGCCTCCGAGAATCCACTATTGCCTGAAAAATTGTCCCAGTCTAAGAGGAAAGTCATCTT
TATTGGGCCTCCAGGTAACGCCATGAGGTCTTTAGGTGATAAAATCTCCTCTACCATTGTCGCTCAAAGTGCTA
AAGTCCCATGTATTCCATGGTCTGGTACCGGTGTTGACACCGTTCACGTGGACGAGAAAACCGGTCTGGTCTC
TGTCGACGATGACATCTATCAAAAGGGTTGTTGTACCTCTCCTGAAGATGGTTTACAAAAGGCCAAGCGTATTG
GTTTTCCTGTCATGATTAAGGCATCCGAAGGTGGTGGTGGTAAAGGTATCAGACAAGTTGAACGTGAAGAAGAT
TTCATCGCTTTATACCACCAGGCAGCCAACGAAATTCCAGGCTCCCCCATTTTCATCATGAAGTTGGCCGGTAG
AGCGCGTCACTTGGAAGTTCAACTGCTAGCAGATCAGTACGGTACAAATATTTCCTTGTTCGGTAGAGACTGTT
CCGTTCAGAGACGTCATCAAAAAATTATCGAAGAAGCACCAGTTACAATTGCCAAGGCTGAAACATTTCACGAG
ATGGAAAAGGCTGCCGTCAGACTGGGGAAACTAGTCGGTTATGTCTCTGCCGGTACCGTGGAGTATCTATATT
CTCATGATGATGGAAAATTCTACTTTTTAGAATTGAACCCAAGATTACAAGTCGAGCATCCAACAACGGAAATGG
TCTCCGGTGTTAACTTACCTGCAGCTCAATTACAAATCGCTATGGGTATCCCTATGCATAGAATAAGTGACATTA
GAACTTTATATGGTATGAATCCTCATTCTGCCTCAGAAATCGATTTCGAATTCAAAACTCAAGATGCCACCAAGA
AACAAAGAAGACCTATTCCAAAGGGTCATTGTACCGCTTGTCGTATCACATCAGAAGATCCAAACGATGGATTC
AAGCCATCGGGTGGTACTTTGCATGAACTAAACTTCCGTTCTTCCTCTAATGTTTGGGGTTACTTCTCCGTGGG
TAACAATGGTAATATTCACTCCTTTTCGGACTCTCAGTTCGGCCATATTTTTGCTTTTGGTGAAAATAGACAAGCT
TCCAGGAAACACATGGTTGTTGCCCTGAAGGAATTGTCCATTAGGGGTGATTTCAGAACTACTGTGGAATACTT
GATCAAACTTTTGGAAACTGAAGATTTCGAGGATAACACTATTACCACCGGTTGGTTGGACGATTTGATTACTCA
TAAAATGACCGCTGAAAAGCCTGATCCAACTCTTGCCGTCATTTGCGGTGCCGCTACAAAGGCTTTCTTAGCAT
CTGAAGAAGCCCGCCACAAGTATATCGAATCCTTACAAAAGGGACAAGTTCTATCTAAAGACCTACTGCAAACT
ATGTTCCCTGTAGATTTTATCCATGAGGGTAAAAGATACAAGTTCACCGTAGCTAAATCCGGTAATGACCGTTAC
ACATTATTTATCAATGGTTCTAAATGTGATATCATACTGCGTCAACTATCTGATGGTGGTCTTTTGATTGCCATAG
GCGGTAAATCGCATACCATCTATTGGAAAGAAGAAGTTGCTGCTACAAGATTATCCGTTGACTCTATGACTACTT
TGTTGGAAGTTGAAAACGATCCAACCCAGTTGCGTACTCCATCCCCTGGTAAATTGGTTAAATTCTTGGTGGAA
```

Figure 12B (continued)

```
AATGGTGAACACATTATCAAGGGCCAACCATATGCAGAAATTGAAGTTATGAAAATGCAAATGCCTTTGGTTTCT
CAAGAAAATGGTATCGTCCAGTTATTAAAGCAACCTGGTTCTACCATTGTTGCAGGTGATATCATGGCTATTATG
ACTCTTGACGATCCATCCAAGGTCAAGCACGCTCTACCATTTGAAGGTATGCTGCCAGATTTTGGTTCTCCAGT
TATCGAAGGAACCAAACCTGCCTATAAATTCAAGTCATTAGTGTCTACTTTGGAAAACATTTTGAAGGGTTATGA
CAACCAAGTTATTATGAACGCTTCCTTGCAACAATTGATAGAGGTTTTGAGAAATCCAAAACTGCCTTACTCAGA
ATGGAAACTACACATCTCTGCTTTACATTCAAGATTGCCTGCTAAGCTAGATGAACAAATGGAAGAGTTAGTTGC
ACGTTCTTTGAGACGTGGTGCTGTTTTCCCAGCTAGACAATTAAGTAAATTGATTGATATGGCCGTGAAGAATCC
TGAATACAACCCCGACAAATTGCTGGGCGCCGTCGTGGAACCATTGGCGGATATTGCTCATAAGTACTCTAAC
GGGTTAGAAGCCCATGAACATTCTATATTTGTCCATTTCTTGGAAGAATATTACGAAGTTGAAAAGTTATTCAAT
GGTCCAAATGTTCGTGAGGAAAATATCATTCTGAAATTGCGTGATGAAAACCCTAAAGATCTAGATAAAGTTGCG
CTAACTGTTTTGTCTCATTCGAAAGTTTCAGCGAAGAATAACCTGATCCTAGCTATCTTGAAACATTATCAACCAT
TGTGCAAGTTATCTTCTAAAGTTTCTGCCATTTTCTCTACTCCTCTACAACATATTGTTGAACTAGAATCTAAGGC
TACCGCTAAGGTCGCTCTACAAGCAAGAGAAATTTTGATTCAAGGCGCTTTACCTTCGGTCAAGGAAAGAACTG
AACAAATTGAACATATCTTAAAATCCTCTGTTGTGAAGGTTGCCTATGGCTCATCCAATCCAAAGCGCTCTGAAC
CAGATTTGAATATCTTGAAGGACTTGATCGATTCTAATTACGTTGTGTTCGATGTTTTACTTCAATTCCTAACCCA
TCAAGACCCAGTTGTGACTGCTGCAGCTGCTCAAGTCTATATTCGTCGTGCTTATCGTGCTTACACCATAGGAG
ATATTAGAGTTCACGAAGGTGTCACAGTTCCAATTGTTGAATGGAAATTCCAACTACCTTCAGCTGCGTTCTCCA
CCTTTCCAACTGTTAAATCTAAAATGGGTATGAACAGGGCTGTTTCTGTTTCAGATTTGTCATATGTTGCAAACA
GTCAGTCATCTCCGTTAAGAGAAGGTATTTTGATGGCTGTGGATCATTTAGATGATGTTGATGAAATTTTGTCAC
AAAGTTTGGAAGTTATTCCTCGTCACCAATCTTCTTCTAACGGACCTGCTCCTGATCGTTCTGGTAGCTCCGCAT
CGTTGAGTAATGTTGCTAATGTTTGTGTTGCTTCTACAGAAGGTTTCGAATCTGAAGAGGAAATTTTGGTAAGGT
TGAGAGAAATTTTGGATTTGAATAAGCAGGAATTAATCAATGCTTCTATCCGTCGTATCACATTTATGTTCGGTTT
TAAAGATGGGTCTTATCCAAAGTATTATACTTTTAACGGTCCAAATTATAACGAAAATGAAACAATTCGTCACATT
GAGCCGGCTTTGGCCTTCCAACTGGAATTAGGAAGATTGTCCAACTTCAACATTAAACCAATTTTCACTGATAAT
AGAAACATCCATGTCTACGAAGCTGTTAGTAAGACTTCTCCATTGGATAAGAGATTCTTTACAAGAGGTATTATT
AGAACGGGTCATATCCGTGATGACATTTCTATTCAAGAATATCTGACTTCTGAAGCTAACAGATTGATGAGTGAT
ATATTGGATAATTTAGAAGTCACCGACACTTCAAATTCTGATTTGAATCATATCTTCATCAACTTCATTGCGGTGT
TTGATATCTCTCCAGAAGATGTCGAAGCCGCCTTCGGTGGTTTCTTAGAAAGATTTGGTAAGAGATTGTTGAGA
TTGCGTGTTTCTTCTGCCGAAATTAGAATCATCATCAAAGATCCTCAAACAGGTGCCCCAGTACCATTGCGTGC
CTTGATCAATAACGTTTCTGGTTATGTTATCAAAACAGAAATGTACACCGAAGTCAAGAACGCAAAAGGTGAATG
GGTATTTAAGTCTTTGGGTAAACCTGGATCCATGCATTTAAGACCTATTGCTACTCCTTACCCTGTTAAGGAATG
GTTGCAACCAAAACGTTATAAGGCACACTTGATGGGTACCACATATGTCTATGACTTCCCAGAATTATTCCGCCA
AGCATCGTCATCCCAATGGAAAAATTTCTCTGCAGATGTTAAGTTAACAGATGATTTCTTTATTTCCAACGAGTT
GATTGAAGATGAAAACGGCGAATTAACTGAGGTGGAAAAGAGAACCTGGTGCCAACGCTATTGGTATGGTTGCC
TTTAAGATTACTGTAAAGACTCCTGAATATCCAAGAGGCCGTCAATTTGTTGTTGTTGCTAACGATATCACATTC
AAGATCGGTTCCTTTGGTCCACAAGAAGACGAATTCTTCAATAAGGTTACTGAATATGCTAGAAAGCGTGGTAT
CCCAAGAATTTACTTGGCTGCAAACTCAGGTGCCAGAATTGGTATGGCTGAAGAGATTGTTCCACTATTTCAAG
TTGCATGGAATGATGCTGCCAATCCGGACAAGGGCTTCCAATACTTATACTTAACAAGTGAAGGTATGGAAACT
TTAAAGAAATTTGACAAAGAAAATTCTGTTCTCACTGAACGTACTGTTATAAACGGTGAAGAAAGATTTGTCATCA
AGACAATTATTGGTTCTGAAGATGGGTTAGGTGTCGAATGTCTACGTGGATCTGGTTTAATTGCTGGTGCAACG
TCAAGGGCTTACCACGATATCTTCACTATCACCTTAGTCACTTGTAGATCCGTCGGTATCGGTGCTTATTTGGTT
CGTTTGGGTCAAAGAGCTATTCAGGTCGAAGGCCAGCCAATTATTTTAACTGGTGCTCCTGCAATCAACAAAAT
GCTGGGTAGAGAAGTTTATACTTCTAACTTACAATTGGGTGGTACTCAAATCATGTATAACAACGGTGTTTCACA
TTTGACTGCTGTTGACGATTTAGCTGGTGTAGAGAAGATTGTTGAATGGATGTCTTATGTTCCAGCCAAGCGTA
ATATGCCAGTTCCTATCTTGGAAACTAAAGACACATGGGATAGACCAGTTGATTTCACTCCAACTAATGATGAAA
CTTACGATGTAAGATGGATGATTGAAGGTCGTGAGACTGAAAGTGGATTTGAATATGGTTTGTTTGATAAAGGG
TCTTTCTTTGAAACTTTGTCAGGATGGGCCAAAGGTGTTGTCGTTGGTAGAGCCCGTCTTGGTGGTATTCCACT
GGGTGTTATTGGTGTTGAAACAAGAACTGTCGAGAACTTGATTCCTGCTGATCCAGCTAATCCAAATAGTGCTG
AAACATTAATTCAAGAACCTGGTCAAGTTTGGCATCCAAACTCCGCCTTCAAGACTGCTCAAGCTATCAATGACT
TTAACAACGGTGAACAATTGCCAATGATGATTTGGCCAACTGGAGAGGTTTCTCTGGTGGTCAACGTGATATG
TTCAACGAAGTCTTGAAGTATGGTTCGTTTATTGTTGACGCATTGGTGGATTACAAACAACCAATTATTATCTATA
TCCCACCTACCGGTGAACTAAGAGGTGGTTCATGGGTTGTTGTCGATCCAACTATCAACGCTGACCAAATGGAA
```

Figure 12B (continued)

```
ATGTATGCCGACGTCAACGCTAGAGCTGGTGTTTTGGAACCACAAGGTATGGTTGGTATCAAGTTCCGTAGAGA
AAAATTGCTGGACACCATGAACAGATTGGATGACAAGTACAGAGAATTGAGATCTCAATTATCCAACAAGAGTTT
GGCTCCAGAAGTACATCAGCAAATATCCAAGCAATTAGCTGATCGTGAGAGAGAACTATTGCCAATTTACGGAC
AAATCAGTCTTCAATTTGCTGATTTGCACGATAGGTCTTCACGTATGGTGGCCAAGGGTGTTATTTCTAAGGAAC
TGGAATGGACCGAGGCACGTCGTTTCTTCTTCTGGAGATTGAGAAGAAGATTGAACGAAGAATATTTGATTAAA
AGGTTGAGCCATCAGGTAGGCGAAGCATCAAGATTAGAAAAGATCGCAAGAATTAGATCGTGGTACCCTGCTT
CAGTGGACCATGAAGATGATAGGCAAGTCGCAACATGGATTGAAGAAAACTACAAAACTTTGGACGATAAACTA
AAGGGTTTGAAATTAGAGTCATTCGCTCAAGACTTAGCTAAAAAGATCAGAAGCGACCATGACAATGCTATTGAT
GGATTATCTGAAGTTATCAAGATGTTATCTACCGATGATAAAGAAAAATTGTTGAAGACTTTGAAATAAAAATTGT
CTGGTGGTGGTGGTTCTGGTGGTGGTGGTTCTGGTGGTGGTGGTTCTGCTGAAGCTTGGTATAATTTGGGTAA
TGCTTATTATAAACAAGGTGATTATCAAAAAGCTATTGAATATTATCAAAAAGCTTTGGAATTGGATCCAAATAAT
GCTGAAGCTTGGTATAATTTGGGTAATGCTTATTATAAACAAGGTGATTATCAAAAAGCTATTGAATATTATCAAA
AAGCTTTGGAATTGGATCCAAATAATGCTGAAGCTTGGTATAATTTGGGTAATGCTTATTATAAACAAGGTGATT
ATCAAAAAGCTATTGAAGATTATCAAAAAGCTTTGGAATTGGATCCAAATAATTTGCAAGCTGAAGCTTGGAAAA
ATTTGGGTAATGCTTATTATAAACAAGGTGATTATCAAAAAGCTATTGAATATTATCAAAAAGCTTTGGAATTGGA
TCCAAATAATGCTTCTGCTTGGTATAATTTGGGTAATGCTTATTATAAACAAGGTGATTATCAAAAAGCTATTGAA
TATTATCAAAAAGCTTTGGAATTGGATCCAAATAATGCTAAAGCTTGGTATAGAAGAGGTAATGCTTATTATAAAC
AAGGTGATTATCAAAAAGCTATTGAAGATTATCAAAAAGCTTTGGAATTGGATCCAAATAATAGATCTAGATCTG
CTGGTGGTGGTGGTTCTGGTGGTGGTGGTTCTGGTGGTGGTGGTGCTTCTGGTTCTCATATGAGATTGGGTGC
TCAATCTATTCAACCAACTGCTAATTTGGATAGAACTGATGATTTGGTTTATTTGAATGTTATGGAATTGGTTAGA
GCTGTTTTGGAATTGAAAAATGAATTGGCTCAATTGCCACCAGAAGGTTATGTTGTTGTTGTTAAAAATGTTGGT
TTGACTTTGAGAAAATTGATTGGTTCTGTTGATGATTTGTTGCCATCTTTGCCATCTTCTTCTAGAACTGAAATTG
AAGGTACTCAAAAATTGTTGAATAAAGATTTGGCTGAATTGATTAATAAAATGAGATTGGCTCAACAAAATGCTG
TTACTTCTTTGTCTGAAGAATGTAAAAGACAAATGTTGACTGCTTCTCATACTTTGGCTGTTGATGCTAAAAATTT
GTTGGATGCTGTTGATCAAGCTAAAGTTTTGGCTAATTTGGCTCATCCACCAGCTGAAGGTTCTGCTGGTTCTG
CTGCTGGTTCTGGTGAATTTGGTTCTGCTGAAGCTGCTGCTAAAGAAGCTGCTGCTAAAGCTGGTTCTGCTGGT
TCTGCTGCTGGTTCTGGTGAATTTGGTTCTGGTGCTATGGCTACTCCAGGTTCTGAAAATGTTTTGCCAAGAGA
ACCATTGATTGCTACTGCTGTTAAATTTTTGCAAAATTCTAGAGTTAGACAATCTCCATTGGCTACTAGAAGAGC
TTTTTTGAAAAAAAAAGGTTTGACTGATGAAGAAATTGATATGGCTTTTCAACAATCTGGTACTGCTGCTGATGA
ACCATCTTCTTTGTGG
```

Figure 12C

Cannabinoidergic Metabolon Scaffold – (Myc)$_3$

ATGGGTTCTGCTGGTTCTGCTGCTGGTTCTGGTGAATTTGGTTCTGCTGGTTCTGCTGCTGGTTCTGGTG
AATTTGGTTCTGCTGGTTCTGCTGCTGGTTCTGGTGAATTTTCTTATTATCATCATCATCATCATTTGG
AATCTACTTCTTTGTATAAAAAAGCTGGTTCTGGTTCTGCTAGAAATGCTTATTTGAGAAAAAAAATTGCTA
GATTGAAAAAAGATAATTTGCAATTGGAAAGAGATGAACAAAATTTGGAAAAAATTATTGCTAATTTGAGAG
ATGAAATTGCTAGATTGGAAAATGAAGTTGCTTCTCATGAACAAGGTTCTGCTGGTTCTGCTGCTGGTTCT
GGTGAATTTGCTGAAGCTGCTGCTAAAGAAGCTGCTGCTAAAGCTGGTTCTGCTGGTTCTGCTGCTGGTT
CTGGTGAATTTTCTTATTATCATCATCATCATCATTTGGAATCTACTTCTTTGTATAAAAAAGCTGGTTC
TGGTTCTAATTTGGTTGCTCAATTGGAAAATGAAGTTGCTTCTTTGGAAAATGAAAATGAAACTTTGAAAAA
AAAAAATTTGCATAAAAAAGATTTGATTGCTTATTTGGAAAAAGAAATTGCTAATTTGAGAAAAAAAATTGAA
GAAGGTTCTGCTGGTTCTGCTGCTGGTTCTGGTGAATTTGGTTCTGCTGAAGCTGCTGCTAAAGAAGCTG
CTGCTAAAGAAGCTGCTGCTAAAGAAGCTGCTGCTAAAGCTGGTTCTGCTGGTTCTGCTGCTGGTTCTGG
TGAATTTGGTTCTTCTTATTATCATCATCATCATCATTTGGAATCTACTTCTTTGTATAAAAAAGCTGGT
TCTGGTTCTCAAAAAGTTGCTGAATTGAAAAATAGAGTTGCTGTTAAATTGAATAGAAATGAACAATTGAAA
AATAAAGTTGAAGAATTGAAAAATAGAAATGCTTATTTGAAAAATGAATTGGCTACTTTGGAAAATGAAGTT
GCTAGATTGGAAAATGATGTTGCTGAAGGTTCTGCTGGTTCTGCTGCTGGTTCTGGTGAATTTGCTGAAGC
TGCTGCTAAAGAAGCTGCTGCTAAAGCTGGTTCTGCTGGTTCTGCTGCTGGTTCTGGTGAATTTTCTTATT
ATCATCATCATCATCATTTGGAATCTACTTCTTTGTATAAAAAAGCTGGTTCTGGTTCTAATGAAGTTAC
TACTTTGGAAAATGATGCTGCTTTTATTGAAAATGAAAATGCTTATTTGGAAAAAGAAATTGCTAGATTGAG
AAAAGAAAAAGCTGCTTTGAGAAATAGATTGGCTCATAAAAAAGGTTCTGCTGGTTCTGCTGCTGGTTCTG
GTGAATTTGGTTCTGCTGAAGCTGCTGCTAAAGAAGCTGCTGCTAAAGAAGCTGCTGCTAAAGAAGCTGC
TGCTAAAGCTGGTTCTGCTGGTTCTGCTGCTGGTTCTGGTGAATTTGGTTCTAGACCACCAACTATTTCTA
ATCCACCACCATTGATTTCTTCTGCTAAACATCCATCTGTTGGTTCTGCTGGTTCTGCTGCTGGTTCTGGT
GAATTTGCTGAAGCTGCTGCTAAAGAAGCTGCTGCTAAAGCTGGTTCTGCTGGTTCTGCTGCTGGTTCTG
GTGAATTTAATTTTTTGCAATCTAGACCAGAACCAACTGCTCCACCAGAAGAATCTTTTAGATCTGGTGGTT
CTGCTGGTTCTGCTGCTGGTTCTGGTGAATTTGGTTCTGCTGAAGCTGCTGCTAAAGAAGCTGCTGCTAA
AGAAGCTGCTGCTAAAGAAGCTGCTGCTAAAGCTGGTTCTGCTGGTTCTGCTGCTGGTTCTGGTGAATTT
GGTTCTTCTAAAGGTACTGGTTTGAATCCAAATGCTAAAGTTTGGCAAGAAATTGCTCCAGGTAATGGTTC
TGCTGGTTCTGCTGCTGGTTCTGGTGAATTTGCTGAAGCTGCTGCTAAAGAAGCTGCTGCTAAAGCTGGT
TCTGCTGGTTCTGCTGCTGGTTCTGGTGAATTTCCAGATGGTGGTACTACTTTTGAACATTTGTGGTCTTC
TTTGGAACCAGATTCTACTTATGGTTCTGCTGGTTCTGCTGCTGGTTCTGGTGAATTTGGTTCTGCTGAAG
CTGCTGCTAAAGAAGCTGCTGCTAAAGAAGCTGCTGCTAAAGAAGCTGCTGCTAAAGCTGGTTCTGCTGG
TTCTGCTGCTGGTTCTGGTGAATTTGGTTCTTCTTATTATCATCATCATCATCATTTGGAATCTACTTCT
TTGTATAAAAAAGCTGGTTCTGGTTCTAAAAGAATTGCTTATTTGAGAAAAAAAATTGCTGCTTTGAAAAAA
GATAATGCTAATTTGGAAAAAGATATTGCTAATTTGGAAAATGAAATTGAAAGATTGATTAAAGAAATTAAAA
CTTTGGAAAATGAAGTTGCTTCTCATGAACAAGGTTCTGCTGGTTCTGCTGCTGGTTCTGGTGAATTTGCT
GAAGCTGCTGCTAAAGAAGCTGCTGCTAAAGCTGGTTCTGCTGGTTCTGCTGCTGGTTCTGGTGAATTTT
CTTATTATCATCATCATCATCATTTGGAATCTACTTCTTTGTATAAAAAGCTGGTTCTGGTTCTAATTT
GTTGGCTACTTTGAGATCTACTGCTGCTGTTTTGGAAAATGAAAATCATGTTTTGGAAAAAGAAAAGAAAA
ATTGAGAAAAGAAAAAGAACAATTGTTGAATAAATTGGAAGCTTATAAAGGTTCTGCTGGTTCTGCTGCTG
GTTCTGGTGAATTTGGTTCTGCTGAAGCTGCTGCTAAAGAAGCTGCTGCTAAAGAAGCTGCTGCTAAAGA
AGCTGCTGCTAAAGCTGGTTCTGCTGGTTCTGCTGCTGGTTCTGGTGAATTTGGTTCTCCAGCTACTTCTC
AACATCCACCACCACCACCAGGTCATAGATCTCAAGCTCCATCTCATGGTTCTGCTGGTTCTGCTGCTGGT
TCTGGTGAATTTGCTGAAGCTGCTGCTAAAGAAGCTGCTGCTAAAGCTGGTTCTGCTGGTTCTGCTGCTG
GTTCTGGTGAATTTGAATTGAATTCTTTGTTGATTTTGTTGGAAGCTGCTGAATATTTGGAAAGAAGAGATA
GAGGTTCTGCTGGTTCTGCTGCTGGTTCTGGTGAATTTGGTTCTGCTGAAGCTGCTGCTAAAGAAGCTGC
TGCTAAAGAAGCTGCTGCTAAAGAAGCTGCTGCTAAAGCTGGTTCTGCTGGTTCTGCTGCTGGTTCTGGT
GAATTTGGTTCTAGACCACCAACTATTTCTAATCCACCACCATTGATTTCTTCTGCTAAACATCCATCTGTT
GGTTCTGCTGGTTCTGCTGCTGGTTCTGGTGAATTTGCTGAAGCTGCTGCTAAAGAAGCTGCTGCTAAAG
CTGGTTCTGCTGGTTCTGCTGCTGGTTCTGGTGAATTTAATTTTTTGCAATCTAGACCAGAACCAACTGCT

Figure 12C (continued)

```
CCACCAGAAGAATCTTTTAGATCTGGTGGTTCTGCTGGTTCTGCTGCTGGTTCTGGTGAATTTGGTTCTGC
TGAAGCTGCTGCTAAAGAAGCTGCTGCTAAAGAAGCTGCTGCTAAAGAAGCTGCTGCTAAAGCTGGTTCT
GCTGGTTCTGCTGCTGGTTCTGGTGAATTTGGTTCTTCTAAAGGTACTGGTTTGAATCCAAATGCTAAAGT
TTGGCAAGAAATTGCTCCAGGTAATGGTTCTGCTGGTTCTGCTGCTGGTTCTGGTGAATTTGCTGAAGCTG
CTGCTAAAGAAGCTGCTGCTAAAGCTGGTTCTGCTGGTTCTGCTGCTGGTTCTGGTGAATTTCCAGATGG
TGGTACTACTTTTGAACATTTGTGGTCTTCTTTGGAACCAGATTCTACTTATGGTTCTGCTGGTTCTGCTGC
TGGTTCTGGTGAATTTGGTTCTGCTGAAGCTGCTGCTAAAGAAGCTGCTGCTAAAGAAGCTGCTGCTAAA
GAAGCTGCTGCTAAAGCTGGTTCTGCTGGTTCTGCTGCTGGTTCTGGTGAATTTGGTTCTTCTTATTATCA
TCATCATCATCATCATTTGGAATCTACTTCTTTGTATAAAAAAGCTGGTTCTGGTTCTAAAAGAATTGCTTAT
TTGAGAAAAAAAATTGCTGCTTTGAAAAAAGATAATGCTAATTTGGAAAAAGATATTGCTAATTTGGAAAAT
GAAATTGAAAGATTGATTAAAGAAATTAAAACTTTGGAAAATGAAGTTGCTTCTCATGAACAAGGTTCTGCT
GGTTCTGCTGCTGGTTCTGGTGAATTTGCTGAAGCTGCTGCTAAAGAAGCTGCTGCTAAAGCTGGTTCTG
CTGGTTCTGCTGCTGGTTCTGGTGAATTTTCTTATTATCATCATCATCATCATTTGGAATCTACTTCTTT
GTATAAAAAAGCTGGTTCTGGTTCTAATTTGTTGGCTACTTTGAGATCTACTGCTGCTGTTTTGGAAAATGA
AAATCATGTTTTGGAAAAAGAAAAAGAAAAATTGAGAAAAGAAAAAGAACAATTGTTGAATAAATTGGAAGC
TTATAAAGGTTCTGCTGGTTCTGCTGCTGGTTCTGGTGAATTTGGTTCTGCTGAAGCTGCTGCTAAAGAAG
CTGCTGCTAAAGAAGCTGCTGCTAAAGAAGCTGCTGCTAAAGCTGGTTCTGCTGGTTCTGCTGCTGGTTC
TGGTGAATTTGGTTCTGCTTTGGTTGATGATGCTGCTGATTATGAACCACCACCATCTAATAATGAAGAAG
CTTTGGGTTCTGCTGGTTCTGCTGCTGGTTCTGGTGAATTTGCTGAAGCTGCTGCTAAAGAAGCTGCTGC
TAAAGCTGGTTCTGCTGGTTCTGCTGCTGGTTCTGGTGAATTTAGAGAATTGTTTGATGATCCATCTTATGT
TAATGTTCAAAATTTGGATAAAGCTAGACAAGGTTCTGCTGGTTCTGCTGCTGGTTCTGGTGAATTTGGTT
CTGCTGAAGCTGCTGCTAAAGAAGCTGCTGCTAAAGAAGCTGCTGCTAAAGAAGCTGCTGCTAAAGCTGG
TTCTGCTGGTTCTGCTGCTGGTTCTGGTGAATTTGGTTCTAAAAATACTAAATCTATGAATTTTGATAATCC
AGTTTATAGAAAAACTACTGAAGAAGAAGGTTCTGCTGGTTCTGCTGCTGGTTCTGGTGAATTTGCTGAAG
CTGCTGCTAAAGAAGCTGCTGCTAAAGCTGGTTCTGCTGGTTCTGCTGCTGGTTCTGGTGAATTTAGATCT
TTGCCATCTACTTGGATTGAAAATAAATTGTATGGTATGTCTGATCCAAATTGGGGTTCTGCTGGTTCTGCT
GCTGGTTCTGGTGAATTTGGTTCTGCTGAAGCTGCTGCTAAAGAAGCTGCTGCTAAAGAAGCTGCTGCTA
AAGAAGCTGCTGCTAAAGCTGGTTCTGCTGGTTCTGCTGCTGGTTCTGGTGAATTTGGTTCTGTTGTTGAT
AATTCTCCACCACCAGCTTTGCCACCAAAAAAAAGACAATCTGCTCCATCTGGTTCTGCTGGTTCTGCTGC
TGGTTCTGGTGAATTTGCTGAAGCTGCTGCTAAAGAAGCTGCTGCTAAAGCTGGTTCTGCTGGTTCTGCT
GCTGGTTCTGGTGAATTTACTCAAAGATCTAAACCACAACCAGCTGTTCCACCAAGACCATCTGCTGATTT
GATTTTGGGTTCTGCTGGTTCTGCTGCTGGTTCTGGTGAATTTGGTTCTGCTGAAGCTGCTGCTAAAGAAG
CTGCTGCTAAAGAAGCTGCTGCTAAAGAAGCTGCTGCTAAAGCTGGTTCTGCTGGTTCTGCTGCTGGTTC
TGGTGAATTTGGTTCTACTGATGAAGAAAGAGAAGAAACTGAAGAAGAAGTTTATTTGTTGAATTCTACTAC
TTTGGGTTCTGCTGGTTCTGCTGCTGGTTCTGGTGAATTTGCTGAAGCTGCTGCTAAAGAAGCTGCTGCTA
AAGCTGGTTCTGCTGGTTCTGCTGCTGGTTCTGGTGAATTTGATGGTAATGTTTCTGGTACTCAAAGATTG
GATTCTGCTACTGTTAGAACTTATTCTTGTGGTTCTGCTGGTTCTGCTGCTGGTTCTGGTGAATTTGGTTCT
GCTGAAGCTGCTGCTAAAGAAGCTGCTGCTAAAGAAGCTGCTGCTAAAGAAGCTGCTGCTAAAGCTGGTT
CTGCTGGTTCTGCTGCTGGTTCTGGTGAATTTGGTTCTTCTTATTATCATCATCATCATCATTTGGAAT
CTACTTCTTTGTATAAAAAAGCTGGTTCTGGTTCTCAAAAAGTTGCTCAATTGAAAAATAGAGTTGCTTATA
AATTGAAAGAAAATGCTAAATTGGAAAATATTGTTGCTAGATTGGAAAATGATAATGCTAATTTGGAAAAAG
ATATTGCTAATTTGGAAAAAGATATTGCTAATTTGGAAAGAGATGTTGCTAGAGGTTCTGCTGGTTCTGCTG
CTGGTTCTGGTGAATTTGCTGAAGCTGCTGCTAAAGAAGCTGCTGCTAAAGCTGGTTCTGCTGGTTCTGC
TGCTGGTTCTGGTGAATTTTCTTATTATCATCATCATCATCATTTGGAATCTACTTCTTTGTATAAAAAA
GCTGGTTCTGGTTCTAATACTGTTAAAGAATTGAAAAATTATATTCAAGAATTGGAAGAAAGAAATGCTGAA
TTGAAAAATTTGAAAGAACATTTGAAATTTGCTAAAGCTGAATTGGAATTTGAATTGGCTGCTCATAAATTT
GAAGGTTCTGCTGGTTCTGCTGCTGGTTCTGGTGAATTTGGTTCTGCTGAAGCTGCTGCTAAAGAAGCTG
CTGCTAAAGAAGCTGCTGCTAAAGAAGCTGCTGCTAAAGCTGGTTCTGCTGGTTCTGCTGCTGGTTCTGG
TGAATTTGGTTCTCATGATGATTCTTTGCCACATCCACAACAAGCTACTGATGATTCTGGTCATGAATCTGA
TGGTTCTGCTGGTTCTGCTGCTGGTTCTGGTGAATTTGCTGAAGCTGCTGCTAAAGAAGCTGCTGCTAAA
```

Figure 12C (continued)

```
GCTGGTTCTGCTGGTTCTGCTGCTGGTTCTGGTGAATTTGGTTCTCCAAATGCTGGTTCTGTTGAACAAAC
TCCAAAAAAACCAGGTTTGAGAAGAAGAGGTTCTGCTGGTTCTGCTGCTGGTTCTGGTGAATTTGGTTCTG
CTGAAGCTGCTGCTAAAGAAGCTGCTGCTAAAGAAGCTGCTGCTAAAGAAGCTGCTGCTAAAGCTGGTTC
TGCTGGTTCTGCTGCTGGTTCTGGTGAATTTGGTTCTTCTTATTATCATCATCATCATCATTTGGAATC
TACTTCTTTGTATAAAAAAGCTGGTTCTGGTTCTTTTGAAAATGTTACTCATGAATTTATTTTGGCTACTTTG
GAAAATGAAAATGCTAAATTGAGAAGATTGGAAGCTAAATTGGAAAGAGAATTGGCTAGATTGAGAAATGA
AGTTGCTTGGTTGGGTTCTGCTGGTTCTGCTGCTGGTTCTGGTGAATTTGCTGAAGCTGCTGCTAAAGAA
GCTGCTGCTAAAGCTGGTTCTGCTGGTTCTGCTGCTGGTTCTGGTGAATTTTCTTATTATCATCATCATCAT
CATCATTTGGAATCTACTTCTTTGTATAAAAAAGCTGGTTCTGGTTCTCAAAAAGTTGAAGAATTGAAAAAT
AAAATTGCTGAATTGGAAAATAGAAATGCTGTTAAAAAAAATAGAGTTGCTCATTTGAAACAAGAAATTGCT
TATTTGAAAGATGAATTGGCTGCTCATGAATTTGAAGGTTCTGCTGGTTCTGCTGCTGGTTCTGGTGAATT
TGGTTCTGCTGAAGCTGCTGCTAAAGAAGCTGCTGCTAAAGAAGCTGCTGCTAAAGAAGCTGCTGCTAAA
GCTGGTTCTGCTGGTTCTGCTGCTGGTTCTGGTGAATTTGGTTCTGTTTCTTCTACTAAATTGGTTTCTTTT
CATGATGATTCTGATGAAGATTTGTTGCATATTGGTTCTGCTGGTTCTGCTGCTGGTTCTGGTGAATTTGCT
GAAGCTGCTGCTAAAGAAGCTGCTGCTAAAGCTGGTTCTGCTGGTTCTGCTGCTGGTTCTGGTGAATTTG
CTGCTGCTACTCCAATTTCTACTTTTCATGATGATTCTGATGAAGATTTGTTGCATGTTGGTTCTGCTGGTT
CTGCTGCTGGTTCTGGTGAATTTGGTTCTGCTGAAGCTGCTGCTAAAGAAGCTGCTGCTAAAGAAGCTGC
TGCTAAAGAAGCTGCTGCTAAAGCTGGTTCTGCTGGTTCTGCTGCTGGTTCTGGTGAATTTGGTTCTTCTT
ATTATCATCATCATCATCATCATTTGGAATCTACTTCTTTGTATAAAAAGCTGGTTCTGGTTCTCAAAAAGT
TGAATCTTTGAAACAAAAAATTGAAGAATTGAAACAAGAAAAGCTCAATTGAAAAATGATATTGCTAATTT
GGAAAAAGAAATTGCTTATGCTGAAACTGGTTCTGCTGGTTCTGCTGCTGGTTCTGGTGAATTTGCTGAAG
CTGCTGCTAAAGAAGCTGCTGCTAAAGCTGGTTCTGCTGGTTCTGCTGCTGGTTCTGGTGAATTTTCTTAT
TATCATCATCATCATCATTTGGAATCTACTTCTTTGTATAAAAAGCTGGTTCTGAATTTTTTAGAAGAG
AAAGAAATAAAATGGCTGCTGCTAAATGTAGAAATAGAAGAAGAGAATTGACTGATACTTTGCAAGCTGAA
ACTGATCAATTGGAAGATGAAAAATCTGCTTTGCAAACTGAAATTGCTAATTTGTTGAAAGAAAAAGAAAAA
TTGGAATTTATTTTGGCTGCTCATAGACCAGCTTGTAAAATTCCAGATGATTTGGGTTTTCCAGAAGAAATG
TCTTTGGAAGGTTCTGCTGGTTCTGCTGCTGGTTCTGGTGAATTTGGTTCTGCTGAAGCTGCTGCTAAAGA
AGCTGCTGCTAAAGAAGCTGCTGCTAAAGAAGCTGCTGCTAAAGCTGGTTCTGCTGGTTCTGCTGCTGGT
TCTGGTGAATTTGGTTCTTTTCAAATGCCAGCTGATACTCCACCACCAGCTTATTTGCCACCAGAAGATCC
AATGACTGGTTCTGCTGGTTCTGCTGCTGGTTCTGGTGAATTTGCTGAAGCTGCTGCTAAAGAAGCTGCT
GCTAAAGCTGGTTCTGCTGGTTCTGCTGCTGGTTCTGGTGAATTTGAAAGAGAATCTAATGAAGAACCACC
ACCACCATATGAAGATCCATATTGGGGTAATGGTGGTTCTGCTGGTTCTGCTGCTGGTTCTGGTGAATTTG
GTTCTGCTGAAGCTGCTGCTAAAGAAGCTGCTGCTAAAGAAGCTGCTGCTAAAGAAGCTGCTGCTAAAGC
TGGTTCTGCTGGTTCTGCTGCTGGTTCTGGTGAATTTGGTTCTTCTTATTATCATCATCATCATCATCATTT
GGAATCTACTTCTTTGTATAAAAAGCTGGTTCTGGTTCTCAAAAAGTTGCTGAATTGAAAATAGAGTTGC
TGTTAAATTGAATAGAAATGAACAATTGAAAAATAAAGTTGAAGAATTGAAAAATAGAAATGCTTATTTGAAA
AATGAATTGGCTACTTTGGAAAATGAAGTTGCTAGATTGGAAAATGATGTTGCTGAAGGTTCTGCTGGTTC
TGCTGCTGGTTCTGGTGAATTTGCTGAAGCTGCTGCTAAAGAAGCTGCTGCTAAAGCTGGTTCTGCTGGT
TCTGCTGCTGGTTCTGGTGAATTTTCTTATTATCATCATCATCATCATTTGGAATCTACTTCTTTGTATA
AAAAAGCTGGTTCTGGTTCTAATGAAGTTACTACTTTGGAAAATGATGCTGCTTTTATTGAAAATGAAATG
CTTATTTGGAAAAAGAAATTGCTAGATTGAGAAAAGAAAAAGCTGCTTTGAGAAATAGATTGGCTCATAAAA
AATCTTATTATCATCATCATCATCATTTGGAATCTACTTCTTTGTATAAAAAGCTGGTTCTGGTTCTGC
TAGAAATGCTTATTTGAGAAAAAAAATTGCTAGATTGAAAAAGATAATTTGCAATTGGAAAGAGATGAACA
AAATTTGGAAAAATTATTGCTAATTTGAGAGATGAAATTGCTAGATTGGAAAATGAAGTTGCTTCTCATGA
ACAAGGTTCTGCTGGTTCTGCTGCTGGTTCTGGTGAATTTGCTGAAGCTGCTGCTAAAGAAGCTGCTGCT
AAAGCTGGTTCTGCTGGTTCTGCTGCTGGTTCTGGTGAATTTTCTTATTATCATCATCATCATCATTTG
GAATCTACTTCTTTGTATAAAAAGCTGGTTCTGGTTCTAATTTGGTTGCTCAATTGGAAAATGAAGTTGCT
TCTTTGGAAAATGAAAATGAAACTTTGAAAAAAAAAATTTGCATAAAAAAGATTTGATTGCTTATTTGGAAA
AAGAAATTGCTAATTTGAGAAAAAAATTGAAGAAGGTTCTGCTGGTTCTGCTGCTGGTTCTGGTGAATTT
GGTTCTGCTGAAGCTGCTGCTAAAGAAGCTGCTGCTAAAGAAGCTGCTGCTAAAGAAGCTGCTGCTAAAG
```

Figure 12C (continued)

```
CTGGTTCTGCTGGTTCTGCTGCTGGTTCTGGTGAATTTGGTTCTGAACAAAAATTGATTTCTGAAGAAGAT
TTGGAACAAAAATTGATTTCTGAAGAAGATTTGGAACAAAAATTGATTTCTGAAGAAGATTTGGGTTCTGCT
GGTTCTGCTGCTGGTTCTGGTGAATTTGGTTCTGCTGGTTCTGCTGCTGGTTCTGGTGAATTTGGTTCTGC
TGGTTCTGCTGCTGGTTCTGGTGAATTT
```

Figure 12D

<u>Malonyl-CoA Metabolon Scaffold – (FLAG)$_3$</u>

```
ATGGGTTCTGCTGGTTCTGCTGCTGGTTCTGGTGAATTTGGTTCTGCTGGTTCTGCTGCTGGTTCTGGTG
AATTTGGTTCTGCTGGTTCTGCTGCTGGTTCTGGTGAATTTTCTTATTATCATCATCATCATCATTTGG
AATCTACTTCTTTGTATAAAAAAGCTGGTTCTGGTTCTGCTAGAAATGCTTATTTGAGAAAAAAAATTGCTA
GATTGAAAAAAGATAATTTGCAATTGGAAAGAGATGAACAAAATTTGGAAAAAATTATTGCTAATTTGAGAG
ATGAAATTGCTAGATTGGAAAATGAAGTTGCTTCTCATGAACAAGGTTCTGCTGGTTCTGCTGCTGGTTCT
GGTGAATTTGCTGAAGCTGCTGCTAAAGAAGCTGCTGCTAAAGCTGGTTCTGCTGGTTCTGCTGCTGGTT
CTGGTGAATTTTCTTATTATCATCATCATCATCATTTGGAATCTACTTCTTTGTATAAAAAAGCTGGTTC
TGGTTCTAATTTGGTTGCTCAATTGGAAAATGAAGTTGCTTCTTTGGAAAATGAAAATGAAACTTTGAAAAA
AAAAAATTTGCATAAAAAAGATTTGATTGCTTATTTGGAAAAAGAAATTGCTAATTTGAGAAAAAAAATTGAA
GAAGGTTCTGCTGGTTCTGCTGCTGGTTCTGGTGAATTTGGTTCTGCTGAAGCTGCTGCTAAAGAAGCTG
CTGCTAAAGAAGCTGCTGCTAAAGAAGCTGCTGCTAAAGCTGGTTCTGCTGGTTCTGCTGCTGGTTCTGG
TGAATTTGGTTCTTCTGCTACTAGAGAATTGGATGAATTGATGGCTTCTTTGTCTGATTTTAAAATTCAAGG
TGGTTCTGCTGGTTCTGCTGCTGGTTCTGGTGAATTTGCTGAAGCTGCTGCTAAAGAAGCTGCTGCTAAA
GCTGGTTCTGCTGGTTCTGCTGCTGGTTCTGGTGAATTTGATTTGGCTTTGTCTGAAAATTGGGCTCAAGA
ATTTTTGGCTGCTGGTGATGCTGTTGATGGTTCTGCTGGTTCTGCTGCTGGTTCTGGTGAATTTGGTTCTG
CTGAAGCTGCTGCTAAAGAAGCTGCTGCTAAAGAAGCTGCTGCTAAAGAAGCTGCTGCTAAAGCTGGTTC
TGCTGGTTCTGCTGCTGGTTCTGGTGAATTTGGTTCTGATTATAAAGATGATGATGATAAAGATTATAAAGA
TGATGATGATAAAGATTATAAAGATGATGATGATAAAGGTTCTGCTGGTTCTGCTGCTGGTTCTGGTGAAT
TTGGTTCTGCTGGTTCTGCTGCTGGTTCTGGTGAATTTGGTTCTGCTGGTTCTGCTGCTGGTTCTGGTGAA
TTT
```

Figure 13A

HCA Gene Cassette Amino Acid Sequences
1. ATP Citrate Lyase (ACL) – Enzyme Linker – cTPR6 Spacer – ID Linker – ID1 (SEQ ID NO:160)

MSAKAISEQTGKELLYKFICTTSAIQNRFKYARVTPDTDWARLLQDHPWLLSQNLVVKPDQLIKRRGK
LGLVGVNLTLDGVKSWLKPRLGQEATVGKATGFLKNFLIEPFVPHSQAEEFYVCIYATREGDYVLFHH
EGGVDVGDVDAKAQKLLVGVDEKLNPEDIKKHLLVHAPEDKKEILASFISGLFNFYEDLYFTYLEINPL
VVTKDGVYVLDLAAKVDATADYICKVKWGDIEFPPPFGREAYPEEAYIADLDAKSGASLKLTLLNPKG
RIWTMVAGGGASVVYSDTICDLGGVNELANYGEYSGAPSEQQTYDYAKTILSLMTREKHPDGKILIIG
GSIANFTNVAATFKGIVRAIRDYQGPLKEHEVTIFVRRGGPNYQEGLRVMGEVGKTTGIPIHVFGTET
HMTAIVGMALGHRPIPNQPPTAAHTANFLLNASGSTSTPAPSRTASFSESRADEVAPAKKAKPAMPQ
DSVPSPRSLQGKSTTLFSRHTKAIVWGMQTRAVQGMLDFDYVCSRDEPSVAAMVYPFTGDHKQKF
YWGHKEILIPVFKNMADAMRKHPEVDVLINFASLRSAYDSTMETMNYAQIRTIAIIAEGIPEALTRKLIKK
ADQKGVTIIGPATVGGIKPGCFKIGNTGGMLDNILASKLYRPGSVAYVSRSGGMSNELNNIISRTTDGV
YEGVAIGGDRYPGSTFMDHVLRYQDTPGVKMIVVLGEIGGTEEYKICRGIKEGRLTKPIVCWCIGTCA
TMFSSEVQFGHAGACANQASETAVAKNQALKEAGVFVPRSFDELGEIIQSVYEDLVANGVIVPAQEV
PPPTVPMDYSWARELGLIRKPASFMTSICDERGQELIYAGMPITEVFKEEMGIGGVLGLLWFQKRLPK
YSCQFIEMCLMVTADHGPAVSGAHNTIICARAGKDLVSSLTSGLLTIGDRFGGALDAAAKMFSKAFDS
GIIPMEFVNKMKKEGKLIMGIGHRVKSINNPDMRVQILKDYVRQHFPATPLLDYALEVEKITTSKKPNLI
LNVDGLIGVAFVDMLRNCGSFTREEADEYIDIGALNGIFVLGRSMGFIGHYLDQKRLKQGLYRHPWD
DISYVLPEHMSMKLSGGGGSGGGGSGGGGSAEAWYNLGNAYYKQGDYQKAIEYYQKALELDPNNA
EAWYNLGNAYYKQGDYQKAIEYYQKALELDPNNAEAWYNLGNAYYKQGDYQKAIEDYQKALELDPN
NLQAEAWKNLGNAYYKQGDYQKAIEYYQKALELDPNNASAWYNLGNAYYKQGDYQKAIEYYQKALE
LDPNNAKAWYRRGNAYYKQGDYQKAIEDYQKALELDPNNRSRAGGGGSGGGGSGGGGASSYYH
HHHHHLESTSLYKKAGSGSNLVAQLENEVASLENENETLKKKNLHKKDLIAYLEKEIANLRKKIEEGSA
GSAAGSGEFGSAEAAAKEAAAKAGSAGSAAGSGEFGSSYYHHHHHHLESTSLYKKAGSGSARNAY
LRKKIARLKKDNLQLERDEQNLEKIIANLRDEIARLENEVASHEQGSG

2. Acetyl-CoA Acetyltransferase (atoB) – Enzyme Linker – cTPR6 Spacer – ID Linker – ID2 (SEQ ID NO:161)

MKNCVIVSAVRTAIGSFNGSLASTSAIDLGATVIKAAIERAKIDSQHVDEVIMGNVLQAGLGQNPARQA
LLKSGLAETVCGFTVNKVCGSGLKSVALAAQAIQAGQAQSIVAGGMENMSLAPYLLDAKARSGYRLG
DGQVYDVILRDGLMCATHGYHMGITAENVAKEYGITREMQDELALHSQRKAAAAIESGAFTAEIVPVN
VVTRKKTFVFSQDEFPKANSTAEALGALRPAFDKAGTVTAGNASGINDGAAALVIMEESAALAAGLTP
LARIKSYASGGVPPALMGMGPVPATQKALQLAGLQLADIDLIEANEAFAAQFLAVGKNLGFDSEKVNV
NGGAIALGHPIGASGARILVTLLHAMQARDKTLGLATLCIGGGQGIAMVIERLNKLSGGGGSGGGGS
GGGGSAEAWYNLGNAYYKQGDYQKAIEYYQKALELDPNNAEAWYNLGNAYYKQGDYQKAIEYYQK
ALELDPNNAEAWYNLGNAYYKQGDYQKAIEDYQKALELDPNNLQAEAWKNLGNAYYKQGDYQKAIE
YYQKALELDPNNASAWYNLGNAYYKQGDYQKAIEYYQKALELDPNNAKAWYRRGNAYYKQGDYQK
AIEDYQKALELDPNNRSRAGGGGSGGGGSGGGGASSYYHHHHHHLESTSLYKKAGSGSNEVTTL
ENDAAFIENENAYLEKEIARLRKEKAALRNRLAHKKGSAGSAAGSGEFGSAEAAAKEAAAKAGSAGS
AAGSGEFGSSYYHHHHHHLESTSLYKKAGSGSQKVAELKNRVAVKLNRNEQLKNKVEELKNRNAYL
KNELATLENEVARLENDVAEGSG

3. 3-Hydroxybutyryl-CoA Dehydrogenase (BHBD) – Enzyme Linker – cTPR6 Spacer – ID Linker – ID3 (SEQ ID NO:162)

MKKVCVIGAGTMGSGIAQAFAAKGFEVVLRDIKDEFVDRGLDFINKNLSKLVKKGKIEEATKVEILTRIS
GTVDLNMAADCDLVIEAAVERMDIKKQIFADLDNICKPETILASNTSSLSITEVASATKRPDKVIGMHFF
NPAPVMKLVEVIRGIATSQETFDAVKETSIAIGKDPVEVAEAPGFVVNRILIPMINEAVGILAEGIASVEDI
DKAMKLGANHPMGPLELGDFIGLDICLAIMDVLYSETGDSKYRPHTLLKKYVRAGWLGRKSGKGFYD

Figure 13A (continued)

YSKKLSGGGGSGGGGSGGGGSAEAWYNLGNAYYKQGDYQKAIEYYQKALELDPNNAEAWYNLGN
AYYKQGDYQKAIEYYQKALELDPNNAEAWYNLGNAYYKQGDYQKAIEDYQKALELDPNNLQAEAWK
NLGNAYYKQGDYQKAIEYYQKALELDPNNASAWYNLGNAYYKQGDYQKAIEYYQKALELDPNNAKA
WYRRGNAYYKQGDYQKAIEDYQKALELDPNNRSRAGGGGSGGGGSGGGGASENLYFQGENLYF
QGDSSESCWNCGRKASETCSGCNTARYCGSFCQHKDWEKHHHICGQTLQAQQGSAGSAAGSGE
FGSAEAAAKEAAAKAGSAGSAAGSGEFGSMAVSESQLKKMVSKYKYRDLTVRETVNVITLYKDLKPV
LDSYVFNDGSSRELMNLTGTIPVPYRGNTYNIPICLWLLDTYPYNPPICFVKPTSSMTIKTGKHVDANG
KIYLPYLHEWKHPQSDLLGLIQVMIVVFGDEPPVFSRPGSG

4. Enoyl-CoA Hydratase (ECH) – Enzyme Linker – cTPR6 Spacer – ID Linker – ID4 (SEQ ID NO:163)

MELNNVILEKEGKVAVVTINRPKALNALNSDTLKEMDYVIGEIENDSEVLAVILTGAGEKSFVAGADISE
MKEMNTIEGRKFGILGNKVFRRLELLEKPVIAAVNGFALGGGCEIAMSCDIRIASSNARFGQPEVGLGI
TPGFGGTQRLSRLVGMGMAKQLIFTAQNIKADEALRIGLVNKVVEPSELMNTAKEIANKIVSNAPVAV
KLSKQAINRGMQCDIDTALAFESEAFGECFSTEDQKDAMTAFIEKRKIEGFKNRKLSGGGGSGGGGS
GGGGSAEAWYNLGNAYYKQGDYQKAIEYYQKALELDPNNAEAWYNLGNAYYKQGDYQKAIEYYQK
ALELDPNNAEAWYNLGNAYYKQGDYQKAIEDYQKALELDPNNLQAEAWKNLGNAYYKQGDYQKAIE
YYQKALELDPNNASAWYNLGNAYYKQGDYQKAIEYYQKALELDPNNAKAWYRRGNAYYKQGDYQK
AIEDYQKALELDPNNRSRAGGGGSGGGGSGGGGASGPLGSPLTASMLASAPPQEQKQMLGERLF
PLIQAMHPTLAGKITGMLLEIDNSELLHMLESPESLRSKVDEAVAVLQAHQAKEAAQKAGSAGSAAGS
GEFGSAEAAAKEAAAKAGSAGSAAGSGEFGSNTNMSVPTDGAVTTSQIPASEQETLVRPKPLLLKLL
KSVGAQKDTYTMKEVLFYLGQYIMTKRLYDEKQQHIVYCSNDLLGDLFGVPSFSVKEHRKIYTMIYRN
LVVGSG

5. Trans-Enoyl-CoA Reductase (ECR) – Enzyme Linker – cTPR6 Spacer – ID Linker – ID5 (SEQ ID NO:164)

MIVKPMVRNNICLNAHPQGCKKGVEDQIEYTKKRITAEVKAGAKAPKNVLVLGCSNGYGLASRITAAF
GYGAATIGVSFEKAGSETKYGTPGWYNNLAFDEAAKREGLYSVTIDGDAFSDEIKAQVIEEAKKKGIK
FDLIVYSLASPVRTDPDTGIMHKSVLKPFGKTFTGKTVDPFTGELKEISAEPANDEEAAATVKVMGGE
DWERWIKQLSKEGLLEEGCITLAYSYIGPEATQALYRKGTIGKAKEHLEATAHRLNKENPSIRAFVSVN
KGLVTRASAVIPVIPLYLASLFKVMKEKGNHEGCIEQITRLYAERLYRKDGTIPVDEENRIRIDDWELEE
DVQKAVSALMEKVTGENAESLTDLAGYRHDFLASNGFDVEGINYEAEVERFDRIKLSGGGGSGGGG
SGGGGSAEAWYNLGNAYYKQGDYQKAIEYYQKALELDPNNAEAWYNLGNAYYKQGDYQKAIEYYQ
KALELDPNNAEAWYNLGNAYYKQGDYQKAIEDYQKALELDPNNLQAEAWKNLGNAYYKQGDYQKAI
EYYQKALELDPNNASAWYNLGNAYYKQGDYQKAIEYYQKALELDPNNAKAWYRRGNAYYKQGDYQ
KAIEDYQKALELDPNNRSRAGGGGSGGGGSGGGGASSYYHHHHHHLESTSLYKKAGSGSNLLAT
LRSTAAVLENENHVLEKEKEKLRKEKEQLLNKLEAYKGSAGSAAGSGEFGSAEAAAKEAAAKAGSA
GSAAGSGEFGSSYYHHHHHHLESTSLYKKAGSGSKRIAYLRKKIAALKKDNANLEKDIANLENEIERLI
KEIKTLENEVASHEQGSG

6. Beta-Ketothiolase (bktB) – Enzyme Linker – cTPR6 Spacer – ID Linker – ID6 (SEQ ID NO:165)

MTREVVVVSGVRTAIGTFGGSLKDVAPAELGALVVREALARAQVSGDDVGHVVFGNVIQTEPRDMY
LGRVAAVNGGVTINAPALTVNRLCGSGLQAIVSAAQTILLGDTDVAIGGGAESMSRAPYLAPAARWG
ARMGDAGLVDMMLGALHDPFHRIHMGVTAENVAKEYDISRAQQDEAALESHRRASAAIKAGYFKDQI
VPVVSKGRKGDVTFDTDEHVRHDATIDDMTKLRPVFVKENGTVTAGNASGLNDAAAAVVMMERAEA
ERRGLKPLARLVSYGHAGVDPKAMGIGPVPATKIALERAGLQVSDLDVIEANEAFAAQACAVTKALGL
DPAKVNPNGSGISLGHPIGATGALITVKALHELNRVQGRYALVTMCIGGGQGIAAIFERIKLSGGGGS
GGGGSGGGGSAEAWYNLGNAYYKQGDYQKAIEYYQKALELDPNNAEAWYNLGNAYYKQGDYQKA
IEYYQKALELDPNNAEAWYNLGNAYYKQGDYQKAIEDYQKALELDPNNLQAEAWKNLGNAYYKQGD
YQKAIEYYQKALELDPNNASAWYNLGNAYYKQGDYQKAIEYYQKALELDPNNAKAWYRRGNAYYKQ

Figure 13A (continued)

GDYQKAIEDYQKALELDPNNRSRSAGGGGSGGGGSGGGGASDVMWEYKWENTGDAELYGPFTSA
QMQTWVSEGYFPDGVYCRKLDPPGGQFYNSKRIDFDLYTGSAGSAAGSGEFGSAEAAAKEAAAKA
GSAGSAAGSGEFGSESDSVEFNNAISYVNKIKTRFLDHPEIYRSFLEILHTYQKEQLHTKGRPFRGMS
EEEVFTEVANLFRGQEDLLSEFGQFLPEAKRGSG

7. Hexanoyl-CoA Synthetase (HCS) (SEQ ID NO:209)

MGKNYKSLDSVVASDFIALGITSEVAETLHGRLAEIVCNYGAATPQTWINIANHILSPDLPFSLHQMLF
YGCYKDFGPAPPAWIPDPEKVKSTNLGALLEKRGKEFLGVKYKDPISSFSHFQEFSVRNPEVYWRTV
LMDEMKISFSKDPECILRRDDINNPGGSEWLPGGYLNSAKNCLNVNSNKKLNDTMIVWRDEGNDDL
PLNKLTLDQLRKRVWLVGYALEEMGLEKGCAIAIDMPMHVDAVVIYLAIVLAGYVVVSIADSFSAPEIS
TRLRLSKAKAIFTQDHIIRGKKRIPLYSRVVEAKSPMAIVIPCSGSNIGAELRDGDISWDYFLERAKEFK
NCEFTAREQPVDAYTNILFSSGTTGEPKAIPWTQATPLKAAADGWSHLDIRKGDVIVWPTNLGWMM
GPWLVYASLLNGASIALYNGSPLVSGFAKFVQDAKVTMLGVVPSIVRSWKSTNCVSGYDWSTIRCFS
SSGEASNVDEYLWLMGRANYKPVIEMCGGTEIGGAFSAGSFLQAQSLSSFSSQCMGCTLYILDKNG
YPMPKNKPGIGELALGPVMFGASKTLLNGNHHDVYFKGMPTLNGEVLRRHGDIFELTSNGYYHAHG
RADDTMNIGGIKISSIEIERVCNEVDDRVFETTAIGVPPLGGGPEQLVIFFVLKDSNDTTIDLNQLRLSF
NLGLQKKLNPLFKVTRVVPLSSLPRTATNKIMRRVLRQQFSHFEGSG

Figure 13B

GPP Gene Cassette Amino Acid Sequences
1. HMG-CoA Synthase (HMGS) – Enzyme Linker – cTPR6 Spacer – ID Linker – ID7 (SEQ ID NO:166)

MKLSTKLCWCGIKGRLRPQKQQQLHNTNLQMTELKKQKTAEQKTRPQNVGIKGIQIYIPTQCVNQSE
LEKFDGVSQGKYTIGLGQTNMSFVNDREDIYSMSLTVLSKLIKSYNIDTNKIGRLEVGTETLIDKSKSVK
SVLMQLFGENTDVEGIDTLNACYGGTNALFNSLNWIESNAWDGRDAIVVCGDIAIYDKGAARPTGGA
GTVAMWIGPDAPIVFDSVRASYMEHAYDFYKPDFTSEYPYVDGHFSLTCYVKALDQVYKSYSKKAIS
KGLVSDPAGSDALNVLKYFDYNVFHVPTCKLVTKSYGRLLYNDFRANPQLFPEVDAELATRDYDESL
TDKNIEKTFVNVAKPFHKERVAQSLIVPTNTGNMYTASVYAAFASLLNYVGSDDLQGKRVGLFSYGS
GLAASLYSCKIVGDVQHIIKELDITNKLAKRITETPKDYEAAIELRENAHLKKNFKPQGSIEHLQSGVYYL
TNIDDKFRRSYDVKKKLSGGGGSGGGGSGGGGSAEAWYNLGNAYYKQGDYQKAIEYYQKALELDP
NNAEAWYNLGNAYYKQGDYQKAIEYYQKALELDPNNAEAWYNLGNAYYKQGDYQKAIEDYQKALEL
DPNNLQAEAWKNLGNAYYKQGDYQKAIEYYQKALELDPNNASAWYNLGNAYYKQGDYQKAIEYYQ
KALELDPNNAKAWYRRGNAYYKQGDYQKAIEDYQKALELDPNNRSRSAGGGGSGGGGSGGGGAS
LGPLPPGWEVRSTVSGRIYFVDHNNRTTQFTDPRLHGSAGSAAGSGEFGSAEAAAKEAAAKAGSAG
SAAGSGEFGSGAMGPLPPGWEKRTDSNGRVYFVNHNTRITQWEDPRSGSG

2. Truncated HMG-CoA Reductase (tHMGR) – Enzyme Linker – cTPR6 Spacer – ID Linker – ID8 (SEQ ID NO:167)

MVAVRRKALSILAEAPVLASDRLPYKNYDYDRVFGACCENVIGYMPLPVGVIGPLVIDGTSYHIPMATT
EGCLVASAMRGCKAINAGGGATTVLTKDGMTRGPVVRFPTLKRSGACKIWLDSEEGQNAIKKAFNS
TSRFARLQHIQTCLAGDLLFMRFRTTTGDAMGMNMISKGVEYSLKQMVEEYGWEDMEVVSVSGNY
CTDKKPAAINWIEGRGKSVVAEATIPGDVVRKVLKSDVSALVELNIAKNLVGSAMAGSVGGFNAHAA
NLVTAVFLALGQDPAQNVESSNCITLMKEVDGDLRISVSMPSIEVGTIGGGTVLEPQGAMLDLLGVRG
PHATAPGTNARQLARIVACAVLAGELSLCAALAAGHLVQSHMTHNRKLSGGGGSGGGGSGGGGSA
EAWYNLGNAYYKQGDYQKAIEYYQKALELDPNNAEAWYNLGNAYYKQGDYQKAIEYYQKALELDPN
NAEAWYNLGNAYYKQGDYQKAIEDYQKALELDPNNLQAEAWKNLGNAYYKQGDYQKAIEYYQKALE

Figure 13B (continued)

LDPNNASAWYNLGNAYYKQGDYQKAIEYYQKALELDPNNAKAWYRRGNAYYKQGDYQKAIEDYQK
ALELDPNNRSRAGGGGSGGGGSGGGGASSYYHHHHHHLESTSLYKKAGSEFFRRERNKMAAAK
CRNRRRELTDTLQAETDQLEDEKSALQTEIANLLKEKEKLEFILAAHRPACKIPDDLGFPEEMSLEGSA
GSAAGSGEFGSAEAAAKEAAAKAGSAGSAAGSGEFGSSYYHHHHHHLESTSLYKKAGSGSQKVES
LKQKIEELKQRKAQLKNDIANLEKEIAYAETGSG

3. Mevalonate Kinase (ERG12) – Enzyme Linker – cTPR6 Spacer – ID Linker – ID9 (SEQ ID NO:168)

MSLPFLTSAPGKVIIFGEHSAVYNKPVAASVSALRTYLLISESSAPDTIELDFPDISFNHKWSINDFNAI
TEDQVNSQKLAKAQQATDGLSQELVSLLDPLLAQLSESFHYHAAFCFLYMFVCLCPHAKNIKFSLKST
LPIGAGLGSSASISVSLALAMAYLGGLIGSNDLEKLSENDKHIVNQWAFIGEKCIHGTPSGIDNAVATY
GNALLFEKDSHNGTINTNNFKFLDDFPAIPMILTYTRIPRSTKDLVARVRVLVTEKFPEVMKPILDAMG
ECALQGLEIMTKLSKCKGTDDEAVETNNELYEQLLELIRINHGLLVSIGVSHPGLELIKNLSDDLRIGST
KLTGAGGGGCSLTLLRRDITQEQIDSFKKKLQDDFSYETFETDLGGTGCCLLSAKNLNKDLKIKSLVF
QLFENKTTTKQQIDDLLLPGNTNLPWTSKLSGGGGSGGGGSGGGGSAEAWYNLGNAYYKQGDYQ
KAIEYYQKALELDPNNAEAWYNLGNAYYKQGDYQKAIEYYQKALELDPNNAEAWYNLGNAYYKQGD
YQKAIEDYQKALELDPNNLQAEAWKNLGNAYYKQGDYQKAIEYYQKALELDPNNASAWYNLGNAYY
KQGDYQKAIEYYQKALELDPNNAKAWYRRGNAYYKQGDYQKAIEDYQKALELDPNNRSRAGGGG
SGGGGSGGGGASMEPAMEPETLEARINRATNPLNKELDWASINGFCEQLNEDFEGPPLATRLLAHKI
QSPQEWEAIQALTVLETCMKSCGKRFHDEVGKFRFLNELIKVVSPKYLGSRTSEKVKNKILELLYSWT
VGLPEEVKIAEAYQMLKKQGIVKSGSAGSAAGSGEFGSAEAAAKEAAAKAGSAGSAAGSGEFGSGA
MGSMAEAEGESLESWLNKATNPSNRQEDWEYIIGFCDQINKELEGPQIAVRLLAHKIQSPQEWEALQ
ALTVLEACMKNCGRRFHNEVGKFRFLNELIKVVSPKYLGDRVSEKVKTKVIELLYSWTMALPEEAKIK
DAYHMLKRQGIVQSDPPIPVDRTLIPSPPPRPKNGSG

4. Phosphomevalonate Kinase (ERG8) – Enzyme Linker – cTPR6 Spacer – ID Linker – ID10 (SEQ ID NO:169)

MSELRAFSAPGKALLAGGYLVLDTKYEAFVVGLSARMHAVAHPYGSLQGSDKFEVRVKSKQFKDGE
WLYHISPKSGFIPVSIGGSKNPFIEKVIANVFSYFKPNMDDYCNRNLFVIDIFSDDAYHSQEDSVTEHR
GNRRLSFHSHRIEEVPKTGLGSSAGGLVTVLTTALASFFVSDLENNVDKYREVIHNLAQVAHCQAQG
KIGSGFDVAAAAYGSIRYRRFPPALISNLPDIGSATYGSKLAHLVDEEDWNITIKSNHLPSGLTLWMGD
IKNGSETVKLVQKVKNWYDSHMPESLKIYTELDHANSRFMDGLSKLDRLHETHDDYSDQIFESLERN
DCTCQKYPEITEVRDAVATIRRSFRKITKESGADIEPPVQTSLLDDCQTLKGVLTCLIPGAGGYDAIAVI
TKQDVDLRAQTANDKRFSKVQWLDVTQADWGVRKEKDPETYLDKKLSGGGGSGGGGSGGGGSA
EAWYNLGNAYYKQGDYQKAIEYYQKALELDPNNAEAWYNLGNAYYKQGDYQKAIEYYQKALELDPN
NAEAWYNLGNAYYKQGDYQKAIEDYQKALELDPNNLQAEAWKNLGNAYYKQGDYQKAIEYYQKALE
LDPNNASAWYNLGNAYYKQGDYQKAIEYYQKALELDPNNAKAWYRRGNAYYKQGDYQKAIEDYQK
ALELDPNNRSRAGGGGSGGGGSGGGGASSYYHHHHHHLESTSLYKKAGSGSQKVEELKNKIAEL
ENRRNAVKKNRVAHLKQEIAYLKDELAAHEFEGSAGSAAGSGEFGSAEAAAKEAAAKAGSAGSAAGS
GEFGSSYYHHHHHHLESTSLYKKAGSGSFENVTHEFILATLENENAKLRRLEAKLERELARLRNEVA
WLGSG

5. Diphosphomevalonate Decarboxylase (MVD1) – Enzyme Linker – cTPR6 Spacer – ID Linker – ID11 (SEQ ID NO:170)

MTVYTASVTAPVNIATLKYWGKRDTKLNLPTNSSISVTLSQDDLRTLTSAATAPEFERDTLWLNGEPH
SIDNERTQNCLRDLRQLRKEMESKDASLPTLSQWKLHIVSENNFPTAAGLASSAAGFAALVSAIAKLY
QLPQSTSEISRIARKGSGSACRSLFGGYVAWEMGKAEDGHDSMAVQIADSSDWPQMKACVLVVSDI
KKDVSSTQGMQLTVATSELFKERIEHVVPKRFEVMRKAIVEKDFATFAKETMMDSNSFHATCLDSFP
PIFYMNDTSKRIISWCHTINQFYGETIVAYTFDAGPNAVLYYLAENESKLFAFIYKLFGSVPGWDKKFT
TEQLEAFNHQFESSNFTARELDLELQKDVARVILTQVGSGPQETNESLIDAKTGLPKEKLSGGGGSG

Figure 13B (continued)

GGGSGGGGSAEAWYNLGNAYYKQGDYQKAIEYYQKALELDPNNAEAWYNLGNAYYKQGDYQKAIE
YYQKALELDPNNAEAWYNLGNAYYKQGDYQKAIEDYQKALELDPNNLQAEAWKNLGNAYYKQGDY
QKAIEYYQKALELDPNNASAWYNLGNAYYKQGDYQKAIEYYQKALELDPNNAKAWYRRGNAYYKQ
GDYQKAIEDYQKALELDPNNRSRSAGGGGSGGGGSGGGGASAMADLEQKVLEMEASTYDGVFIW
KISDFPRKRQEAVAGRIPAIFSPAFYTSRYGYKMCLRIYLNGDTGRGTHLSLFFVVMKGPNDALLRW
PFNQKVTLMLLDQNNREHVIDAFRPDVTSSSFQRPVNDMNIASGCPLFCPVSKMEAKNSYVRDDAIFI
KAIVDLTGLGSAGSAAGSGEFGSAEAAAKEAAAKAGSAGSAAGSGEFGSASIKLQSSDGEIFEVDVEI
AKQSVTIKTMLEDLGMDDEGDDDPVPLPNVNAAILKKVIQWCTHHKDDPPPPEDDENKEKRTDDIPV
WDQEFLKVDQGTLFELILAANYLDIKGLLDVTCKTVANMIKGKTPEEIRKTFNIKNDFTEEEEAQVRKE
NQWCGSG

6. Isopentenyl-Diphosphate Delta-Isomerase (IDI1) – Enzyme Linker – cTPR6 Spacer – ID Linker – ID12 (SEQ ID NO:171)

MTADNNSMPHGAVSSYAKLVQNQTPEDILEEFPEIIPLQQRPNTRSSETSNDESGETCFSGHDEEQI
KLMNENCIVLDWDDNAIGAGTKKVCHLMENIEKGLLHRAFSVFIFNEQGELLLQQRATEKITFPDLWT
NTCCSHPLCIDDELGLKGKLDDKIKGAITAAVRKLDHELGIPEDETKTRGKFHFLNRIHYMAPSNEPW
GEHEIDYILFYKINAKENLTVNPNVNEVRDFKWVSPNDLKTMFADPSYKFTPWFKIICENYLFNWWEQ
LDDLSEVENDRQIHRMLKLSGGGGSGGGGSGGGGSAEAWYNLGNAYYKQGDYQKAIEYYQKALEL
DPNNAEAWYNLGNAYYKQGDYQKAIEYYQKALELDPNNAEAWYNLGNAYYKQGDYQKAIEDYQKA
LELDPNNLQAEAWKNLGNAYYKQGDYQKAIEYYQKALELDPNNASAWYNLGNAYYKQGDYQKAIEY
YQKALELDPNNAKAWYRRGNAYYKQGDYQKAIEDYQKALELDPNNRSRSAGGGGSGGGGSGGGG
ASSYYHHHHHHLESTSLYKKAGSGSNTVKELKNYIQELEERNAELKNLKEHLKFAKAELEFELAAHKF
EGSAGSAAGSGEFGSAEAAAKEAAAKAGSAGSAAGSGEFGSSYYHHHHHHLESTSLYKKAGSGSQ
KVAQLKNRVAYKLKENAKLENIVARLENDNANLEKDIANLEKDIANLERDVARGSG

7. Geranyl-Diphosphate Synthase (ERG20$^{WW}$) – Enzyme Linker – cTPR6 Spacer – ID Linker – ID13 (SEQ ID NO:172)

MEAKIDELINNDPVWSSQNESLISKPYNHILLKPGKNFRLNLIVQINRVMNLPKDQLAIVSQIVELLHNS
SLLIDDIEDNAPLRRGQTTSHLIWGVPSTINTANYMYFRAMQLVSQLTTKEPLYHWLITIFNEELINLHR
GQGLDIYWRDFLPEIIPTQEMYLNMVMNKTGGLFRLTLRLMEALSPSSHHGHSLVPFINLLGIIYQIRD
DYLNLKDFQMSSEKGFAEDITEGKLSFPIVHALNFTKTKGQTEQHNEILRILLLRTSDKDIKLKLIQILEF
DTNSLAYTKNFINQLVNMIKNDNENKYLPDLASHSDTATNLHDELLYIIDHLSELKLSGGGGSGGGGS
GGGGSAEAWYNLGNAYYKQGDYQKAIEYYQKALELDPNNAEAWYNLGNAYYKQGDYQKAIEYYQK
ALELDPNNAEAWYNLGNAYYKQGDYQKAIEDYQKALELDPNNLQAEAWKNLGNAYYKQGDYQKAIE
YYQKALELDPNNASAWYNLGNAYYKQGDYQKAIEYYQKALELDPNNAKAWYRRGNAYYKQGDYQK
AIEDYQKALELDPNNRSRSAGGGGSGGGGSGGGGASLCTMKKGPSGYGFNLHSDKSKPGQFIRSV
DPDSPAEASGLRAQDRIVEVNGVCMEGKQHGDVVSAIRAGGDETKLLVVDREGSAGSAAGSGEFG
SAEAAAKEAAAKAGSAGSAAGSGEFGSSSGAIIYTVELKRYGGPLGITISGTEEPFDPIIISSLTKGGLA
ERTGAIHIGDRILAINSSSLKGKPLSEAIHLLQMAGETVTLKIKKQTDAQPASSGSG

Figure 13C

CAN Gene Cassette Amino Acid Sequences

1. Olivetol Synthase (OS) – Enzyme Linker – cTPR6 Spacer – ID Linker – ID14 (SEQ ID NO:175)

MNHLRAEGPASVLAIGTANPENILLQDEFPDYYFRVTKSEHMTQLKEKFRKICDKSMIRKRNCFLNEE
HLKQNPRLVEHEMQTLDARQDMLVVEVPKLGKDACAKAIKEWGQPKSKITHLIFTSASTTDMPGADY
HCAKLLGLSPSVKRVMMYQLGCYGGGTVLRIAKDIAENNKGARVLAVCCDIMACLFRGPSESDLELL
VGQAIFGDGAAAVIVGAEPDESVGERPIFELVSTGQTILPNSEGTIGGHIREAGLIFDLHKDVPMLISNN

Figure 13C (continued)

IEKCLIEAFTPIGISDWNSIFWITHPGGKAILDKVEEKLHLKSDKFVDSRHVLSEHGNMSSSTVLFVMDE
LRKRSLEEGKSTTGDGFEWGVLFGFGPGLTVERVVVRSVPIKYKLSGGGGSGGGGSGGGGSAEA
WYNLGNAYYKQGDYQKAIEYYQKALELDPNNAEAWYNLGNAYYKQGDYQKAIEYYQKALELDPNNA
EAWYNLGNAYYKQGDYQKAIEDYQKALELDPNNLQAEAWKNLGNAYYKQGDYQKAIEYYQKALELD
PNNASAWYNLGNAYYKQGDYQKAIEYYQKALELDPNNAKAWYRRGNAYYKQGDYQKAIEDYQKAL
ELDPNNRSRSAGGGGSGGGGSGGGGASGNNLETYEWYNKSISRDKAEKLLLDTGKEGAFMVRDS
RTPGTYTVSVFTKAIISENPCIKHYHIKETNDSPKRYYVAEKYVFDSIPLLIQYHQYNGGGLVTRLRYPV
CGGSAGSAAGSGEFGSAEAAAKEAAAKAGSAGSAAGSGEFGSGSHPWFFGKIPRAKAEEMLSKQR
HDGAFLIRESESAPGDFSLSVKFGNDVQHFKVLRDGAGKYFLWVVKFNSLNELVDYHRSTSVSRNQ
QIFLRDIEQVPQQPTGSG

2. Olivetolic Acid Cyclase (OAC) – Enzyme Linker – cTPR6 Spacer – ID Linker – ID15 (SEQ ID NO:176)

MAVKHLIVLKFKDEITEAQKEEFFKTYVNLVNIIPAMKDVYWGKDVTQKNKEEGYTHIVEVTFESVETI
QDYIIHPAHVGFGDVYRSFWEKLLIFDYTPRKKLSGGGGSGGGGSGGGGSAEAWYNLGNAYYKQG
DYQKAIEYYQKALELDPNNAEAWYNLGNAYYKQGDYQKAIEYYQKALELDPNNAEAWYNLGNAYYK
QGDYQKAIEDYQKALELDPNNLQAEAWKNLGNAYYKQGDYQKAIEYYQKALELDPNNASAWYNLGN
AYYKQGDYQKAIEYYQKALELDPNNAKAWYRRGNAYYKQGDYQKAIEDYQKALELDPNNRSRSAG
GGGSGGGGSGGGGASGQDRSEATLIKRFKGEGVRYKAKLIGIDEVSAARGDKLCQDSMMKLKGVV
AGARSKGEHKQKIFLTISFGGIKIFDEKTGALQHHHAVHEISYIAKDITDHRAFGYVCGKEGNHRFVAIK
TAQAAEPVILDLRDLFQLIYELKQREELEKKAGSAGSAAGSGEFGSAEAAAKEAAAKAGSAGSAAGS
GEFGSGSHMGSQFWVTSQKTEASERCGLQGSYILRVEAEKLTLLTLGAQSQILEPLLFWPYTLLRRY
GRDKVMFSFEAGRRCPSGPGTFTFQTSQGNDIFQAVEAAIQQQKAQGKVGQAQDILRLEHHHHHH
GSG

3. CBGA Synthase (CBGAS) – Enzyme Linker – cTPR6 Spacer – ID Linker – ID16 (SEQ ID NO:177)

MGLSSVCTFSFQTNYHTLLNPHNNNPKTSLLCYRHPKTPIKYSYNNFPSKHCSTKSFHLQNKCSESL
SIAKNSIRAATTNQTEPPESDNHSVATKILNFGKACWKLQRPYTIIAFTSCACGLFGKELLHNTNLISW
SLMFKAFFFLVAILCIASFTTTINQIYDLHIDRINKPDLPLASGEISVNTAWIMSIIVALFGLIITIKMKGGPL
YIFGYCFGIFGGIVYSVPPFRWKQNPSTAFLLNFLAHIITNFTFYYASRAALGLPFELRPSFTFLLAFMK
SMGSALALIKDASDVEGDTKFGISTLASKYGSRNLTLFCSGIVLLSYVAAILAGIIWPQAFNSNVMLLSH
AILAFWLILQTRDFALTNYDPEAGRRFYEFMWKLYYAEYLVYVFIKLSGGGGSGGGGSGGGGSAEA
WYNLGNAYYKQGDYQKAIEYYQKALELDPNNAEAWYNLGNAYYKQGDYQKAIEYYQKALELDPNNA
EAWYNLGNAYYKQGDYQKAIEDYQKALELDPNNLQAEAWKNLGNAYYKQGDYQKAIEYYQKALELD
PNNASAWYNLGNAYYKQGDYQKAIEYYQKALELDPNNAKAWYRRGNAYYKQGDYQKAIEDYQKAL
ELDPNNRSRSAGGGGSGGGGSGGGGASAEYVRALFDFNGNDEEDLPFKKGDILRIRDKPEEQWW
NAEDSEGKRGMIPVPYVEKYGSAGSAAGSGEFGSAEAAAKEAAAKAGSAGSAAGSGEFGSLIKHMR
AEALFDFTGNSKLELNFKAGDVIFLLSRINKDWLEGTVRGATGIFPLSFVKILKGSG

4. CBDA Synthase (CBDAS) (SEQ ID NO:173)

MKCSTFSFWFVCKIIFFFFSFNIQTSIANPRENFLKCFSQYIPNNATNLKLVYTQNNPLYMSVLNSTIHN
LRFTSDTTPKPLVIVTPSHVSHIQGTILCSKKVGLQIRTRSGGHDSEGMSYISQVPFVIVDLRNMRSIKI
DVHSQTAWVEAGATLGEVYYWVNEKNENLSLAAGYCPTVCAGGHFGGGGYGPLMRNYGLAADNII

DAHLVNVHGKVLDRKSMGEDLFWALRGGGAESFGIIVAWKIRLVAVPKSTMFSVKKIMEIHELVKLVN
KWQNIAYKYDKDLLLMTHFITRNITDNQGKNKTAIHTYFSSVFLGGVDSLVDLMNKSFPELGIKKTDCR
QLSWIDTIIFYSGVVNYDTDNFNKEILLDRSAGQNGAFKIKLDYVKKPIPESVFVQILEKLYEEDIGAGM
YALYPYGGIMDEISESAIPFPHRAGILYELWYICSWEKQEDNEKHLNWIRNIYNFMTPYVSKNPRLAYL
NYRDLDIGINDPKNPNNYTQARIWGEKYFGKNFDRLVKVKTLVDPNNFFRNEQSIPPLPRHRHGSG

Figure 13C (continued)

5. CBCA Synthase (CBCAS) (SEQ ID NO:174)

MNCSTFSFWFVCKIIFFFLSFNIQISIANPQENFLKCFSEYIPNNPANPKFIYTQHDQLYMSVLNSTIQNL
RFTSDTTPKPLVIVTPSNVSHIQASILCSKKVGLQIRTRSGGHDAEGLSYISQVPFAIVDLRNMHTVKV
DIHSQTAVWEAGATLGEVYYWINEMNENFSFPGGYCPTVGVGGHFSGGGYGALMRNYGLAADNIID
AHLVNVDGKVLDRKSMGEDLFWAIRGGGGENFGIIAACKIKLVVVPSKATIFSVKKNMEIHGLVKLFNK
WQNIAYKYDKDLMLTTHFRTRNITDNHGKNKTTVHGYFSSIFLGGVDSLVDLMNKSFPELGIKKTDCK
ELSWIDTTIFYSGVVNYNTANFKKEILLDRSAGKKTAFSIKLDYVKKLIPETAMVKILEKLYEEEVGVGM
YVLYPYGGIMDEISESAIPFPHRAGIMYELWYTATWEKQEDNEKHINWVRSVYNFTTPYVSQNPRLA
YLNYRDLDLGKTNPESPNNYTQARIWGEKYFGKNFNRLVKVKTKADPNNFFRNEQSIPPLPPRHHGS
G

6. Acetyl-CoA Carboxylase (ACC) – Enzyme Linker – cTPR6 Spacer – ID Linker – ID17 (SEQ ID NO:178)

MSEESLFESSPQKMEYEITNYSERHTELPGHFIGLNTVDKLEESPLRDFVKSHGGHTVISKILIANNGIA
AVKEIRSVRKWAYETFGDDRTVQFVAMATPEDLEANAEYIRMADQYIEVPGGTNNNNYANVDLIVDIA
ERADVDAVWAGWGHASENPLLPEKLSQSKRKVIFIGPPGNAMRSLGDKISSTIVAQSAKVPCIPWSG
TGVDTVHVDEKTGLVSVDDDIYQKGCCTSPEDGLQKAKRIGFPVMIKASEGGGGKGIRQVEREEDFI
ALYHQAANEIPGSPIFIMKLAGRARHLEVQLLADQYGTNISLFGRDCSVQRRHQKIIEEAPVTIAKAETF
HEMEKAAVRLGKLVGYVSAGTVEYLYSHDDGKFYFLELNPRLQVEHPTTEMVSGVNLPAAQLQIAM
GIPMHRISDIRTLYGMNPHSASEIDFEFKTQDATKKQRRPIPKGHCTACRITSEDPNDGFKPSGGTLH
ELNFRSSSNVWGYFSVGNNGNIHSFSDSQFGHIFAFGENRQASRKHMVVALKELSIRGDFRTTVEYL
IKLLETEDFEDNTITTGWLDDLITHKMTAEKPDPTLAVICGAATKAFLASEEARHKYIESLQKGQVLSKD
LLQTMFPVDFIHEGKRYKFTVAKSGNDRYTLFINGSKCDIILRQLSDGGLLIAIGGKSHTIYWKEEVAAT
RLSVDSMTTLLEVENDPTQLRTPSPGKLVKFLVENGEHIIKGQPYAEIEVMKMQMPLVSQENGIVQLL
KQPGSTIVAGDIMAIMTLDDPSKVKHALPFEGMLPDFGSPVIEGTKPAYKFKSLVSTLENILKGYDNQV
IMNASLQQLIEVLRNPKLPYSEWKLHISALHSRLPAKLDEQMEELVARSLRRGAVFPARQLSKLIDMA
VKNPEYNPDKLLGAVVEPLADIAHKYSNGLEAHEHSIFVHFLEEYYEVEKLFNGPNVREENIILKLRDE
NPKDLDKVALTVLSHSKVSAKNNLILAILKHYQPLCKLSSKVSAIFSTPLQHIVELESKATAKVALQAREI
LIQGALPSVKERTEQIEHILKSSVVKVAYGSSNPKRSEPDLNILKDLIDSNYVVFDVLLQFLTHQDPVVT
AAAAQVYIRRAYRAYTIGDIRVHEGVTVPIVEWKFQLPSAAFSTFPTVKSKMGMNRAVSVSDLSYVAN
SQSSPLREGILMAVDHLDDVDEILSQSLEVIPRHQSSSNGPAPDRSGSSASLSNVANVCVASTEGFE
SEEEILVRLREILDLNKQELINASIRRITFMFGFKDGSYPKYYTFNGPNYNENETIRHIEPALAFQLELGR
LSNFNIKPIFTDNRNIHVYEAVSKTSPLDKRFFTRGIIRTGHIRDDISIQEYLTSEANRLMSDILDNLEVTD
TSNSDLNHIFINFIAVFDISPEDVEAAFGGFLERFGKRLLRLRVSSAEIRIIIKDPQTGAPVPLRALINNVS
GYVIKTEMYTEVKNAKGEWVFKSLGKPGSMHLRPIATPYPVKEWLQPKRYKAHLMGTTYVYDFPELF
RQASSSQWKNFSADVKLTDDFFISNELIEDENGELTEVEREPGANAIGMVAFKITVKTPEYPRGRQFV
VVANDITFKIGSFGPQEDEFFNKVTEYARKRGIPRIYLAANSGARIGMAEEIVPLFQVAWNDAANPDK
GFQYLYLTSEGMETLKKFDKENSVLTERTVINGEERFVIKTIIGSEDGLGVECLRGSGLIAGATSRAYH
DIFTITLVTCRSVGIGAYLVRLGQRAIQVEGQPIILTGAPAINKMLGREVYTSNLQLGGTQIMYNNGVSH
LTAVDDLAGVEKIVEWMSYVPAKRNMPVPILETKDTWDRPVDFTPTNDETYDVRWMIEGRETESGF
EYGLFDKGSFFETLSGWAKGVVVGRARLGGIPLGVIGVETRTVENLIPADPANPNSAETLIQEPGQV
WHPNSAFKTAQAINDFNNGEQLPMMILANWRGFSGGQRDMFNEVLKYGSFIVDALVDYKQPIIIYIPP
TGELRGGSWVVVDPTINADQMEMYADVNARAGVLEPQGMVGIKFRREKLLDTMNRLDDKYRELRS
QLSNKSLAPEVHQQISKQLADRERELLPIYGQISLQFADLHDRSSRMVAKGVISKELEWTEARRFFFW
RLRRRLNEEYLIKRLSHQVGEASRLEKIARIRSWYPASVDHEDDRQVATWIEENYKTLDDKLKGLKLE
SFAQDLAKKIRSDHDNAIDGLSEVIKMLSTDDKEKLLKTLKKLSGGGGSGGGGSGGGGSAEAWYNL
GNAYYKQGDYQKAIEYYQKALELDPNNAEAWYNLGNAYYKQGDYQKAIEYYQKALELDPNNAEAWY
NLGNAYYKQGDYQKAIEDYQKALELDPNNLQAEAWKNLGNAYYKQGDYQKAIEYYQKALELDPNNA
SAWYNLGNAYYKQGDYQKAIEYYQKALELDPNNAKAWYRRGNAYYKQGDYQKAIEDYQKALELDP

Figure 13C (continued)

NNRSRSAGGGGSGGGGSGGGGASGSHMRLGAQSIQPTANLDRTDDLVYLNVMELVRAVLELKNEL
AQLPPEGYVVVVKNVGLTLRKLIGSVDDLLPSLPSSSRTEIEGTQKLLNKDLAELINKMRLAQQNAVTS
LSEECKRQMLTASHTLAVDAKNLLDAVDQAKVLANLAHPPAEGSAGSAAGSGEFGSAEAAAKEAAA
KAGSAGSAAGSGEFGSGAMATPGSENVLPREPLIATAVKFLQNSRVRQSPLATRRAFLKKKGLTDEE
IDMAFQQSGTAADEPSSLWGSG

Figure 13D

SCF Gene Cassette Amino Acid Sequences
1. <u>Cannabinoidergic Metabolon Scaffold (CBSCFLD) – (Myc)$_3$ (SEQ ID NO:179)</u>

MGSAGSAAGSGEFGSAGSAAGSGEFGSAGSAAGSGEFSYYHHHHHHLESTSLYKKAGSGSARNA
YLRKKIARLKKDNLQLERDEQNLEKIIANLRDEIARLENEVASHEQGSAGSAAGSGEFAEAAAKEAAA
KAGSAGSAAGSGEFSYYHHHHHHLESTSLYKKAGSGSNLVAQLENEVASLENENETLKKKNLHKKD
LIAYLEKEIANLRKKIEEGSAGSAAGSGEFGSAEAAAKEAAAKEAAAKEAAAKAGSAGSAAGSGEFGS
SYYHHHHHHLESTSLYKKAGSGSQKVAELKNRVAVKLNRNEQLKNKVEELKNRNAYLKNELATLENE
VARLENDVAEGSAGSAAGSGEFAEAAAKEAAAKAGSAGSAAGSGEFSYYHHHHHHLESTSLYKKA
GSGSNEVTTLENDAAFIENENAYLEKEIARLRKEKAALRNRLAHKKGSAGSAAGSGEFGSAEAAAKE
AAAKEAAAKEAAAKAGSAGSAAGSGEFGSRPPTISNPPPLISSAKHPSVGSAGSAAGSGEFAEAAAK
EAAAKAGSAGSAAGSGEFNFLQSRPEPTAPPEESFRSGGSAGSAAGSGEFGSAEAAAKEAAAKEA
AAKEAAAKAGSAGSAAGSGEFGSSKGTGLNPNAKVWQEIAPGNGSAGSAAGSGEFAEAAAKEAAA
KAGSAGSAAGSGEFPDGGTTFEHLWSSLEPDSTYGSAGSAAGSGEFGSAEAAAKEAAAKEAAAKE
AAAKAGSAGSAAGSGEFGSSYYHHHHHHLESTSLYKKAGSGSKRIAYLRKKIAALKKDNANLEKDIA
NLENEIERLIKEIKTLENEVASHEQGSAGSAAGSGEFAEAAAKEAAAKAGSAGSAAGSGEFSYYHHH
HHHLESTSLYKKAGSGSNLLATLRSTAAVLENENHVLEKEKEKLRKEKEQLLNKLEAYKGSAGSAAG
SGEFGSAEAAAKEAAAKEAAAKEAAAKAGSAGSAAGSGEFGSPATSQHPPPPPGHRSQAPSHGSA
GSAAGSGEFAEAAAKEAAAKAGSAGSAAGSGEFELNSLLILLEAAEYLERRDRGSAGSAAGSGEFG
SAEAAAKEAAAKEAAAKEAAAKAGSAGSAAGSGEFGSRPPTISNPPPLISSAKHPSVGSAGSAAGSG
EFAEAAAKEAAAKAGSAGSAAGSGEFNFLQSRPEPTAPPEESFRSGGSAGSAAGSGEFGSAEAAAK
EAAAKEAAAKAGSAGSAAGSGEFGSSKGTGLNPNAKVWQEIAPGNGSAGSAAGSGEFAEA
AAKEAAAKAGSAGSAAGSGEFPDGGTTFEHLWSSLEPDSTYGSAGSAAGSGEFGSAEAAAKEAAA
KEAAAKEAAAKAGSAGSAAGSGEFGSSYYHHHHHHLESTSLYKKAGSGSKRIAYLRKKIAALKKDNA
NLEKDIANLENEIERLIKEIKTLENEVASHEQGSAGSAAGSGEFAEAAAKEAAAKAGSAGSAAGSGEF
SYYHHHHHHLESTSLYKKAGSGSNLLATLRSTAAVLENENHVLEKEKEKLRKEKEQLLNKLEAYKGS
AGSAAGSGEFGSAEAAAKEAAAKEAAAKEAAAKAGSAGSAAGSGEFGSALVDDAADYEPPPSNNE
EALGSAGSAAGSGEFAEAAAKEAAAKAGSAGSAAGSGEFRELFDDPSYVNVQNLDKARQGSAGSA
AGSGEFGSAEAAAKEAAAKEAAAKEAAAKAGSAGSAAGSGEFGSKNTKSMNFDNPVYRKTTEEEG
SAGSAAGSGEFAEAAAKEAAAKAGSAGSAAGSGEFRSLPSTWIENKLYGMSDPNWGSAGSAAGSG
EFGSAEAAAKEAAAKEAAAKEAAAKAGSAGSAAGSGEFGSVVDNSPPPALPPKKRQSAPSGSAGSA
AGSGEFAEAAAKEAAAKAGSAGSAAGSGEFTQRSKPQPAVPPRPSADLILGSAGSAAGSGEFGSAE
AAAKEAAAKEAAAKEAAAKAGSAGSAAGSGEFGSTDEEREETEEEVYLLNSTTLGSAGSAAGSGEF
AEAAAKEAAAKAGSAGSAAGSGEFDGNVSGTQRLDSATVRTYSCGSAGSAAGSGEFGSAEAAAKE
AAAKEAAAKEAAAKAGSAGSAAGSGEFGSSYYHHHHHHLESTSLYKKAGSGSQKVAQLKNRVAYKL
KENAKLENIVARLENDNANLEKDIANLEKDIANLERDVARGSAGSAAGSGEFAEAAAKEAAAKAGSA
GSAAGSGEFSYYHHHHHHLESTSLYKKAGSGSNTVKELKNYIQELEERNAELKNLKEHLKFAKAELE
FELAAHKFEGSAGSAAGSGEFGSAEAAAKEAAAKEAAAKAGSAGSAAGSGEFGSHDDSLPH
PQQATDDSGHESDGSAGSAAGSGEFAEAAAKEAAAKAGSAGSAAGSGEFGSPNAGSVEQTPKKP
GLRRRGSAGSAAGSGEFGSAEAAAKEAAAKEAAAKAGSAGSAAGSGEFGSSYYHHHHHHL
ESTSLYKKAGSGSFENVTHEFILATLENENAKLRRLEAKLERELARLRNEVAWLGSAGSAAGSGEFA
EAAAKEAAAKAGSAGSAAGSGEFSYYHHHHHHLESTSLYKKAGSGSQKVEELKNKIAELENRNAVK

Figure 13D (continued)

KNRVAHLKQEIAYLKDELAAHEFEGSAGSAAGSGEFGSAEAAAKEAAAKEAAAKEAAAKAGSAGSA
AGSGEFGSVSSTKLVSFHDDSDEDLLHIGSAGSAAGSGEFAEAAAKEAAAKAGSAGSAAGSGEFAA
ATPISTFHDDSDEDLLHVGSAGSAAGSGEFGSAEAAAKEAAAKEAAAKEAAAKAGSAGSAAGSGEF
GSSYYHHHHHHLESTSLYKKAGSGSQKVESLKQKIEELKQRKAQLKNDIANLEKEIAYAETGSAGSAA
GSGEFAEAAAKEAAAKAGSAGSAAGSGEFSYYHHHHHHLESTSLYKKAGSEFFRRERNKMAAAKC
RNRRRELTDTLQAETDQLEDEKSALQTEIANLLKEKEKLEFILAAHRPACKIPDDLGFPEEMSLEGSA
GSAAGSGEFGSAEAAAKEAAAKEAAAKEAAAKAGSAGSAAGSGEFGSFQMPADTPPPAYLPPEDP
MTGSAGSAAGSGEFAEAAAKEAAAKAGSAGSAAGSGEFERESNEEPPPPYEDPYWGNGGSAGSA
AGSGEFGSAEAAAKEAAAKEAAAKEAAAKAGSAGSAAGSGEFGSSYYHHHHHHLESTSLYKKAGS
GSQKVAELKNRVAVKLNRNEQLKNKVEELKNRNAYLKNELATLENEVARLENDVAEGSAGSAAGSG
EFAEAAAKEAAAKAGSAGSAAGSGEFSYYHHHHHHLESTSLYKKAGSGSNEVTTLENDAAFIENENA
YLEKEIARLRKEKAALRNRLAHKKSYYHHHHHHLESTSLYKKAGSGSARNAYLRKKIARLKKDNLQLE
RDEQNLEKIIANLRDEIARLENEVASHEQGSAGSAAGSGEFAEAAAKEAAAKAGSAGSAAGSGEFSY
YHHHHHHLESTSLYKKAGSGSNLVAQLENEVASLENENETLKKKNLHKKDLIAYLEKEIANLRKKIEEG
SAGSAAGSGEFGSAEAAAKEAAAKEAAAKEAAAKAGSAGSAAGSGEFGSEQKLISEEDLEQKLISEE
DLEQKLISEEDLGSAGSAAGSGEFGSAGSAAGSGEFGSAGSAAGSGEFGSG

2. Malonyl-CoA Metabolon Scaffold (MCASCFLD) – (FLAG)₃ (SEQ ID NO:180)

MGSAGSAAGSGEFGSAGSAAGSGEFGSAGSAAGSGEFSYYHHHHHHLESTSLYKKAGSGSARNA
YLRKKIARLKKDNLQLERDEQNLEKIIANLRDEIARLENEVASHEQGSAGSAAGSGEFAEAAAKEAAA
KAGSAGSAAGSGEFSYYHHHHHHLESTSLYKKAGSGSNLVAQLENEVASLENENETLKKKNLHKKD
LIAYLEKEIANLRKKIEEGSAGSAAGSGEFGSAEAAAKEAAAKEAAAKEAAAKAGSAGSAAGSGEFGS
SATRELDELMASLSDFKIQGGSAGSAAGSGEFAEAAAKEAAAKAGSAGSAAGSGEFDLALSENWAQ
EFLAAGDAVDGSAGSAAGSGEFGSAEAAAKEAAAKEAAAKEAAAKAGSAGSAAGSGEFGSDYKDD
DDKDYKDDDDKDYKDDDDKGSAGSAAGSGEFGSAGSAAGSGEFGSAGSAAGSGEFGSG

Figure 14A

Codon-optimized HCA Gene Cassette Nucleotide Sequences
1. ATP Citrate Lyase (ACL) – Enzyme Linker – cTPR6 Spacer – ID Linker – ID1 (SEQ ID NO:181)

ATGAGTGCTAAGGCAATTTCTGAACAAACTGGTAAAGAATTGTTGTACAAGTTTATTTGTACTACA
TCAGCCATCCAAAATAGATTCAAATACGCTAGAGTTACCCCAGATACTGACTGGGCTAGATTGTT
ACAAGATCATCCATGGTTGTTATCTCAAAACTTGGTTGTCAAACCTGACCAATTAATTAAGAGAAG
AGGTAAATTGGGTTTAGTAGGTGTTAATTTGACATTGGATGGTGTAAAGTCTTGGTTGAAACCAA
GATTAGGTCAAGAAGCCACAGTTGGTAAAGCTACCGGTTTCTTGAAAAATTTCTTGATCGAACCA
TTTGTCCCTCATTCACAAGCCGAAGAATTCTATGTATGTATCTACGCTACTAGAGAGGGTGACTA
TGTTTTATTTCATCACGAAGGTGGTGTCGACGTAGGTGACGTTGACGCCAAGGCTCAAAAGTTGT
TGGTTGGTGTCGATGAAAAGTTGAACCCAGAAGACATTAAAAAGCATTTGTTGGTTCACGCACCT
GAAGATAAAAAGGAAATATTGGCCTCCTTTATAAGTGGTTTGTTTAATTTCTACGAAGATTTGTAC
TTCACCTACTTGGAAATTAACCCATTAGTAGTTACTAAGGATGGTGTATATGTTTTGGACTTAGCT
GCAAAAGTTGATGCAACAGCCGACTACATTTGTAAGGTCAAATGGGGTGACATCGAATTTCCACC
TCCATTCGGTAGAGAAGCTTATCCAGAAGAAGCCTACATTGCTGATTTGGACGCTAAGTCTGGTG
CATCATTGAAGTTGACATTGTTGAACCCTAAAGGTAGAATTTGGACCATGGTTGCTGGTGGTGGT
GCTAGTGTCGTATATTCTGATACTATATGCGACTTGGGTGGTGTTAACGAATTGGCAAACTACGG
TGAATACTCAGGTGCCCCATCCGAACAACAAACATACGATTACGCTAAGACCATCTTGTCCTTAA
TGACTAGAGAAAAGCATCCTGATGGTAAAATCTTGATCATCGGTGGTAGTATCGCAAATTTTACT
AACGTTGCCGCTACATTCAAGGGTATCGTCAGAGCTATAAGAGATTACCAAGGTCCATTGAAGG
AACACGAAGTAACAATATTCGTTAGAAGAGGTGGTCCTAACTACCAAGAAGGTTTGAGAGTCATG
GGTGAAGTAGGTAAAACCACTGGTATACCAATCCATGTCTTTGGTACAGAAACCCACATGACTGC
AATAGTTGGTATGGCCTTAGGTCATAGACCAATCCCTAATCAACCTCCAACCGCAGCCCACACTG
CAAATTTCTTGTTAAACGCCTCTGGTTCAACTTCCACACCAGCTCCTTCTAGAACAGCAAGTTTCT
CTGAATCAAGAGCTGATGAAGTCGCTCCAGCTAAGAAAGCAAAACCAGCCATGCCTCAAGACTC
CGTTCCAAGTCCTAGATCTTTGCAGGGTAAATCTACTACTTTGTTTTCTAGACATACTAAGGCTAT
AGTATGGGGTATGCAAACAAGAGCAGTTCAAGGCATGTTGGATTTCGACTATGTTTGTAGTAGAG
ATGAACCATCTGTTGCTGCAATGGTCTATCCTTTTACTGGTGACCATAAGCAAAAATTCTACTGG
GGTCACAAGGAAATATTGATCCCAGTTTTTAAGAACATGGCCGATGCTATGAGAAAACATCCTGA
AGTCGACGTATTGATTAACTTCGCCTCATTAAGATCCGCTTACGATTCTACAATGGAAACCATGA
ACTACGCTCAAATAAGAACCATCGCTATCATTGCAGAAGGTATTCCAGAAGCCTTGACTAGAAAG
TTGATTAAGAAAGCTGATCAAAAAGGTGTCACAATAATCGGTCCAGCTACCGTAGGTGGTATTAA
GCCTGGTTGTTTCAAGATCGGTAACACTGGTGGTATGTTGGATAACATATTGGCATCTAAGTTGT
ATAGACCAGGTTCAGTCGCTTACGTATCCAGAAGTGGTGGTATGTCCAACGAATTGAACAACATC
ATCAGTAGAACTACAGATGGTGTATACGAAGGTGTTGCTATTGGTGGTGACAGATACCCAGGTT
CTACTTTTATGGATCATGTATTGAGATATCAAGACACACCTGGTGTTAAATGATTGTTGTCTTGG
GTGAAATAGGTGGTACTGAAGAATACAAGATATGCAGAGGTATCAAAGAAGGTAGATTGACAAA
GCCAATCGTTTGTTGGTGCATTGGTACTTGTGCAACAATGTTTTCTTCAGAAGTTCAATTCGGTCA
TGCAGGTGCCTGCGCTAATCAAGCTTCAGAAACAGCAGTTGCCAAGAACCAAGCATTAAAAGAA
GCCGGTGTTTTTGTCCCTAGATCTTTCGATGAATTAGGTGAAATCATTCAATCAGTCTATGAAGAC
TTGGTAGCTAATGGTGTAATTGTTCCAGCACAAGAAGTTCCTCCACCTACTGTCCCTATGGATTA
CTCTTGGGCAAGAGAATTGGGTTTAATTAGAAAGCCAGCTAGTTTTATGACCTCTATATGTGATG
AAAGAGGTCAAGAATTGATCTATGCTGGTATGCCTATTACTGAAGTATTCAAAGAAGAAATGGGT
ATCGGTGGTGTTTTAGGTTTGTTGTGGTTCCAAAAGAGATTGCCAAAGTACTCTTGTCAATTCATT
GAAATGTGCTTAATGGTTACAGCTGATCATGGTCCTGCTGTCTCAGGTGCACACAATACCATAAT
CTGCGCTAGAGCTGGTAAAGATTTGGTTTCTTCTTTGACCTCAGGTTTGTTAACTATTGGTGACA
GATTTGGTGGTGCATTAGACGCCGCTGCAAAGATGTTTTCAAAAGCTTTCGATTCCGGTATAATC
CCAATGGAATTCGTTAATAAGATGAAAAGGAGGGTAAATTGATAATGGGTATCGGTCATCGTGT
TAAGTCTATCAATAACCCTGATATGAGAGTACAAATCTTGAAGGACTATGTTAGACAACACTTTCC
AGCCACACCTTTGTTAGATTACGCTTTGGAAGTTGAAAAGATTACCACTTCTAAAAAGCCAAATTT

Figure 14A (continued)

GATCTTGAACGTTGATGGTTTAATTGGTGTTGCTTTTGTCGACATGTTGAGAAACTGTGGTTCCTT
CACTAGAGAAGAAGCTGATGAATATATCGACATTGGTGCATTGAATGGTATCTTTGTTTTAGGTA
GATCTATGGGTTTCATTGGTCATTACTTGGATCAAAAGAGATTAAAGCAAGGTTTGTACAGACAT
CCATGGGATGACATTTCTTACGTTTTACCTGAACACATGTCAATGAAATTGTCTGGTGGTGGTGG
TTCTGGTGGTGGTGGTTCTGGTGGTGGTGGTAGTGCCGAAGCTTGGTACAATTTGGGTAACGCA
TACTACAAGCAGGGTGACTACCAAAAGGCAATTGAATATTACCAAAAGGCCTTGGAATTAGACCC
AAATAACGCAGAAGCCTGGTATAATTTGGGTAATGCTTATTATAAACAGGGTGACTATCAAAAGG
CTATCGAATACTACCAAAAGGCATTGGAATTAGACCCTAATAACGCTGAAGCATGGTATAATTTG
GGTAACGCTTATTATAAGCAGGGTGACTATCAAAAGCCATCGAAGACTACCAAAAGGCTTTGGA
ATTAGATCCAAATAACTTACAAGCCGAAGCTTGGAAGAATTTGGGTAACGCTTACTATAAACAGG
GTGACTACCAAAAGCAATTGAATACTATCAAAAAGCTTTAGAATTGGACCCTAATAACGCATCA
GCCTGGTACAATTTGGGTAATGCTTACTATAAGCAGGGTGACTATCAGAAGGCCATTGAATACTA
TCAAAAGGCTTTAGAATTGGATCCAAATAACGCTAAAGCATGGTACAGACGTGGTAACGCTTATT
ACAAACAGGGTGACTACCAGAAAGCCATTGAAGATTATCAAAAGGCTTTGGAATTGGATCCTAAC
AACAGATCTAGATCAGCTGGTGGTGGTGGTTCTGGTGGTGGTGGTTCTGGTGGTGGTGGTGCTT
CTTCATATTACCATCACCATCACCATCACTTGGAATCCACAAGTTTATACAAAAAGGCTGGTTCTG
GTTCAAATTTGGTCGCACAATTGGAAAACGAAGTAGCCTCTTTAGAAAATGAAAACGAAACCTTG
AAAAAGAAAAACTTACATAAGAAAGATTTGATCGCTTATTTGGAAAAGGAAATCGCAAATTTGAGA
AAGAAAATTGAAGAAGGTAGTGCAGGTTCTGCCGCTGGTTCTGGTGAATTTGGTTCAGCTGAAG
CAGCCGCTAAGGAAGCAGCCGCTAAAGCCGGTTCAGCTGGTTCCGCAGCCGGTTCTGGTGAAT
TCGGTTCCAGTTACTATCACCATCACCATCATCACTTGGAATCCACTAGTTTATATAAGAAAGCAG
GTTCTGGTTCAGCAAGAAATGCCTACTTGAGAAAGAAAATAGCTAGATTAAAGAAAGATAACTTG
CAATTGGAAAGAGATGAACAAAATTTGGAAAAGATTATCGCCAACTTAAGAGATGAAATCGCTAG
ATTGGAAAATGAAGTTGCATCCCATGAACAAGGTAGTGGT

2. Acetyl-CoA Acetyltransferase (atoB) – Enzyme Linker – cTPR6 Spacer – ID Linker – ID2 (SEQ ID NO:182)

ATGAAAAACTGTGTAATCGTTTCTGCTGTTAGAACTGCAATTGGTTCCTTTAATGGTAGTTTGGCC
TCTACATCAGCTATTGATTTGGGTGCTACCGTCATCAAAGCTGCAATTGAAAGAGCAAAGATTGA
TTCTCAACATGTCGACGAAGTAATAATGGGTAACGTTTTGCAAGCTGGTTTAGGTCAAAATCCAG
CAAGACAAGCCTTGTTAAAATCTGGTTTAGCAGAAACTGTATGTGGTTTCACAGTTAATAAGGTCT
GCGGTTCTGGTTTGAAGTCAGTTGCTTTAGCCGCTCAAGCTATACAAGCAGGTCAAGCCCAATCT
ATCGTCGCTGGTGGTATGGAAAATATGTCATTGGCACCTTATTTGTTAGATGCAAAAGCCAGATC
AGGTTATAGATTAGGTGACGGTCAAGTATACGACGTTATTTTGAGAGATGGTTTAATGTGCGCTA
CTCATGGTTATCACATGGGTATTACAGCAGAAATGTTGCCAAAGAATACGGTATAACCAGAGAA
ATGCAAGATGAATTGGCATTACATTCCCAAAGAAAGGCAGCCGCTGCAATCGAAAGTGGTGCTT
TTACTGCAGAAATTGTCCCAGTAAACGTTGTCACAAGAAAGAAAACTTTCGTTTTCTCCCAAGATG
AATTCCCAAAAGCTAATAGTACCGCTGAAGCATTGGGTGCTTTAAGACCTGCATTCGACAAGGCC
GGTACCGTAACTGCCGGTAATGCTTCTGGTATAAACGATGGTGCCGCTGCATTGGTTATCATGG
AAGAATCAGCCGCTTTAGCAGCCGGTTTGACACCTTTAGCTAGAATTAAATCTTATGCATCAGGT
GGTGTTCCACCTGCTTTGATGGGTATGGGTCCAGTCCCTGCTACCCAAAAGGCATTGCAATTAG
CCGGTTTGCAATTGGCTGATATCGACTTAATCGAAGCAAACGAAGCCTTTGCTGCACAATTCTTG
GCAGTTGGTAAAAATTTGGGTTTCGACTCCGAAAAGGTTAATGTCAACGGTGGTGCCATTGCTTT
GGGTCATCCAATAGGTGCTTCAGGTGCAAGAATCTTGGTTACATTGTTGCATGCCATGCAAGCTA
GAGATAAAACCTTGGGTTTAGCTACTTTGTGTATCGGTGGTGGTCAAGGTATCGCAATGGTTATC
GAAAGATTGAATAAGTTGTCTGGTGGTGGTGGTTCTGGTGGTGGTGGTTCTGGTGGTGGTGGTA
GTGCAGAAGCCTGGTACAATTTGGGTAACGCTTACTACAAGCAGGGTGACTACCAAAAGGCAAT
CGAATACTACCAAAAGGCCTTGGAATTAGATCCAAATAACGCTGAAGCATGGTATAATTTGGGTA
ATGCCTATTATAAACAGGGTGACTATCAAAAGCTATTGAATATTACCAAAAGGCATTGGAATTAG

Figure 14A (continued)

ATCCTAATAACGCCGAAGCTTGGTATAATTTGGGTAACGCCTATTATAAGCAGGGTGACTATCAA
AAGGCCATCGAAGATTACCAAAAGGCTTTGGAATTGGATCCAAACAACTTGCAAGCAGAAGCCT
GGAAGAATTTGGGTAACGCTTATTACAAACAGGGTGACTACCAAAAAGCTATTGAATACTATCAA
AAAGCCTTAGAATTGGATCCTAATAACGCTTCTGCATGGTACAATTTGGGTAATGCCTACTATAAA
CAGGGTGACTACCAGAAGGCTATTGAATACTACCAAAAAGCATTAGAATTGGATCCAAATAACGC
CAAGGCTTGGTACAGACGTGGTAATGCCTATTACAAGCAGGGTGACTACCAGAAAGCCATAGAA
GACTATCAAAAAGCCTTGGAATTGGATCCTAACAACAGATCCAGAAGTGCTGGTGGTGGTGGTT
CTGGTGGTGGTGGTTCTGGTGGTGGTGGTGCTTCTTCATATTACCATCACCATCACCATCACTTG
GAATCTACATCATTATACAAAAAGGCTGGTTCCGGTAGTAATGAAGTTACTACATTGGAAAACGA
TGCCGCTTTTATCGAAAACGAAAACGCATACTTGGAAAAGGAAATCGCCAGATTAAGAAAGGAAA
AGGCAGCCTTGAGAAATAGATTAGCCCATAAAAAGGGTTCCGCTGGTAGTGCTGCAGGTTCTGG
TGAATTTGGTTCAGCTGAAGCCGCTGCAAAAGAAGCCGCTGCAAAGGCAGGTTCTGCCGGTTCA
GCCGCTGGTTCTGGTGAATTCGGTTCCAGTTACTATCACCATCACCATCATCACTTGGAATCTAC
TTCATTATATAAAAAGGCCGGTTCCGGTAGTCAAAAAGTCGCTGAATTAAAGAACAGAGTAGCTG
TTAAGTTGAACAGAAACGAACAATTGAAAAATAAGGTAGAAGAATTGAAAAATAGAAACGCCTAC
TTAAAGAATGAATTGGCAACATTGGAAAACGAAGTCGCTAGATTGGAAAATGATGTAGCAGAAGG
TTCTGGT 3. 3-Hydroxybutyryl-CoA Dehydrogenase (BHBD) – Enzyme Linker – cTPR6 Spacer – ID Linker – ID3
(SEQ ID NO:183)

ATGAAAAAGGTTTGTGTCATTGGTGCTGGTACCATGGGTTCTGGTATAGCACAAGCCTTTGCTGC
AAAAGGTTTCGAAGTTGTCTTGAGAGATATCAAGGACGAATTCGTTGATAGAGGTTTGGACTTCA
TCAATAAGAACTTGTCTAAGTTGGTTAAAAAGGGTAAAATCGAAGAAGCTACAAAGGTAGAAATC
TTGACCAGAATTTCAGGTACTGTTGATTTGAATATGGCCGCTGATTGTGACTTGGTAATCGAAGC
AGCCGTTGAAAGAATGGATATTAAGAAACAAATCTTCGCAGATTTGGACAACATCTGCAAACCTG
AAACAATCTTAGCCTCAAACACCTCTTCATTGTCCATTACTGAAGTCGCTAGTGCAACAAAAGA
CCAGATAAGGTAATAGGCATGCATTTCTTTAATCCAGCTCCTGTTATGAAGTTGGTAGAAGTTATT
AGAGGTATAGCAACATCTCAAGAAACCTTTGACGCTGTTAAGGAAACTTCAATAGCAATCGGTAA
AGATCCAGTCGAAGTAGCCGAAGCTCCTGGTTTCGTAGTTAACAGAATCTTGATACCTATGATCA
ACGAAGCTGTTGGTATCTTGGCTGAAGGTATTGCATCTGTCGAAGATATTGACAAAGCCATGAAG
TTAGGTGCTAATCACCCAATGGGTCCTTTGGAATTGGGTGACTTTATTGGTTTGGACATATGTTTA
GCTATCATGGACGTTTTGTATTCCGAAACAGGTGACAGTAAATACAGACCACATACCTTGTTGAA
GAAATATGTTAGAGCAGGTTGGTTAGGTAGAAAGTCTGGTAAAGGTTTCTACGATTACTCTAAAA
AGTTGTCTGGTGGTGGTGGTTCTGGTGGTGGTGGTTCTGGTGGTGGTGGTAGTGCAGAAGCCT
GGTACAATTTGGGTAACGCTTACTACAAGCAGGGTGACTACCAAAAGGCCATAGAATACTACCAA
AAAGGCTTTGGAATTGGATCCTAATAACGCTGAAGCATGGTATAATTTGGGTAATGCATATTATAAA
CAGGGTGACTATCAAAAGGCAATCGAATACTACCAAAAGGCCTTGGAATTAGATCCAAATAACGC
CGAAGCTTGGTATAATTTGGGTAACGCCTATTATAAGCAGGGTGACTATCAAAAGCTATCGAAG
ATTACCAAAAGGCATTGGAATTGGATCCTAACAACTTACAAGCAGAAGCCTGGAAGAATTTGGGT
AACGCATATTACAAACAGGGTGACTACCAAAAGCCATTGAATATTATCAAAAAGCTTTGGAATTG
GATCCAAATAACGCTTCAGCATGGTACAATTTGGGTAATGCCTATTACAAGCAGGGTGACTATCA
GAAAGCTATTGAATATTATCAAAAGGCTTTGGAATTAGATCCTAATAACGCCAAGGCTTGGTACA
GACGTGGTAATGCCTATTACAAGCAGGGTGACTACCAGAAGGCCATTGAAGACTATCAAAAAGC
CTTGGAATTGGATCCAAACAACAGATCTAGATCAGCTGGTGGTGGTGGTTCTGGTGGTGGTGGT
TCTGGTGGTGGTGGTGCTTCCGAAAATTTGTACTTCCAAGGTGAAACTTGTACTTCCAGGGTGA
CTCCAGTGAAGTTGTTGGAATTGCGGTAGAAAAGCCTCCGAAACCTGTAGTGGTTGCAACACT
GCTAGATATTGTGGTTCTTTTTGCCAACACAAAGATTGGGAAAAGCATCACCATATTTGTGGTCA
AACATTACAAGCACAACAAGGTTCTGCCGGTTCAGCTGCAGGTTCTGGTGAATTTGGTTCCGCT
GAAGCCGCTGCAAAAGAAGCCGCTGCAAAGGCAGGTTCCGCCGGTAGTGCCGCTGGTAGTGGT

Figure 14A (continued)

GAATTCGGTTCTATGGCAGTTTCCGAAAGTCAATTGAAGAAAATGGTTTCTAAGTACAAGTACAG
AGATTTGACTGTTAGAGAAACAGTTAACGTCATCACTTTGTACAAGGATTTGAAGCCAGTCTTGG
ACTCATACGTTTTTAATGATGGTTCTTCAAGAGAATTGATGAACTTAACTGGTACAATACCAGTTC
CTTACCGTGGTAACACTTACAACATCCCAATCTGTTTGTGGTTGTTAGATACATATCCTTACAATC
CACCTATCTGCTTCGTCAAACCAACATCCAGTATGACCATTAAAACTGGTAAACATGTTGATGCTA
ACGGTAAAATATATTTGCCATACTTACACGAATGGAAGCATCCTCAATCAGACTTGTTGGGTTTAA
TCCAAGTAATGATCGTCGTATTTGGTGACGAACCACCTGTTTTCTCTAGACCAGGTTCAGGT

4. Enoyl-CoA Hydratase (ECH) – Enzyme Linker – cTPR6 Spacer – ID Linker – ID4 (SEQ ID NO:184)

ATGGAATTGAACAACGTTATATTGGAAAAGGAGGGTAAAGTCGCTGTTGTCACTATAAATAGACC
AAAGGCATTGAACGCCTTGAACTCTGATACATTGAAGGAAATGGACTACGTTATCGGTGAAATTG
AAAACGATTCAGAAGTCTTAGCAGTAATTTTGACCGGTGCCGGTGAAAATCCTTTGTTGCCGGT
GCTGATATCAGTGAAATGAAGGAAATGAACACTATCGAAGGTAGAAAGTTCGGTATCTTGGGTAA
CAAGGTTTTCAGAAGATTGGAATTGTTGGAAAAGCCTGTTATAGCTGCAGTCAATGGTTTCGCTT
TGGGTGGTGGTTGTGAAATCGCAATGTCCTGCGATATTAGAATAGCTTCTTCAAACGCAAGATTT
GGTCAACCAGAAGTCGGTTTAGGTATTACACCTGGTTTCGGTGGTACCCAAAGATTATCTAGATT
GGTTGGTATGGGTATGGCCAAGCAATTGATTTTTACTGCTCAAAACATCAAGGCTGATGAAGCAT
TGAGAATCGGTTTGGTTAATAAGGTAGTTGAACCATCTGAATTGATGAACACCGCCAAGGAAATC
GCTAATAAGATTGTTTCTAATGCTCCAGTTGCTGTCAAGTTGAGTAAGCAAGCTATAAATCGTGG
TATGCAATGTGATATCGACACTGCATTGGCCTTCGAATCTGAAGCATTTGGTGAATGCTTCTCAA
CAGAAGATCAAAAAGACGCAATGACCGCCTTTATCGAAAGAGAAAGATAGAAGGTTTCAAAAAC
AGAAAGTTATCTGGTGGTGGTGGTTCTGGTGGTGGTGGTTCTGGTGGTGGTAGTGCTGAAG
CATGGTACAATTTGGGTAACGCTTACTACAAGCAGGGTGACTACCAAAAGGCAATCGAATACTAC
CAAAAGGCCTTGGAATTGGACCCAAATAACGCCGAAGCTTGGTATAATTTGGGTAATGCCTATTA
TAAACAGGGTGACTATCAAAAGCTATAGAATACTACCAAAAGGCATTGGAATTGGACCCTAATA
ACGCAGAAGCCTGGTATAATTTGGGTAACGCCTATTATAAGCAGGGTGACTATCAAAAGGCCATA
GAAGACTACCAAAAGGCTTTGGAATTGGATCCAAACAACTTACAAGCTGAAGCATGGAAGAATTT
GGGTAACGCTTATTACAAACAGGGTGACTACCAAAAAGCTATTGAATATTATCAAAAAGCTTTAGA
ATTAGACCCTAATAACGCCTCTGCTTGGTACAATTTGGGTAATGCCTACTATAAACAGGGTGACT
ACCAGAAGGCTATTGAATATTACCAAAAAGCTTTAGAATTGGATCCAAATAACGCAAAGGCCTGG
TACAGACGTGGTAATGCCTATTACAAGCAGGGTGACTACCAGAAAGCCATTGAAGATTATCAAAA
AGCTTTGGAATTGGATCCTAACAACAGATCCAGAAGTGCTGGTGGTGGTGGTTCTGGTGGTGGT
GGTTCTGGTGGTGGTGGTGCTTCTGGTCCATTGGGTTCCCCTTTGACTGCATCAATGTTAGCTTC
CGCACCACCTCAAGAACAAAAGCAAATGTTGGGTGAAAGATTATTCCCATTGATACAAGCTATGC
ATCCTACTTTAGCAGGTAAAATCACAGGCATGTTGTTGGAAATCGATAACTCTGAATTGTTACACA
TGTTAGAATCCCCAGAAAGTTTGAGATCTAAAGTTGACGAAGCCGTAGCTGTTTTGCAAGCTCAT
CAAGCAAAAGAAGCCGCTCAAAAGGCCGGTTCAGCTGGTTCCGCAGCCGGTAGTGGTGAATTT
GGTTCTGCTGAAGCTGCAGCCAAAGAAGCTGCAGCCAAGGCAGGTAGTGCCGGTTCTGCTGCA
GGTTCTGGTGAATTCGGTTCCAATACCAACATGAGTGTCCCAACTGATGGTGCTGTAACTACATC
TCAAATTCCTGCATCAGAACAAGAAACTTTAGTTAGACCAAAGCCTTTGTTGTTGAAGTTGTTGAA
GTCAGTAGGTGCTCAAAAGATACCTACACTATGAAGGAAGTTTTATTTTATTTGGGTCAATACAT
CATGACAAAGAGATTATACGATGAAAGCAACAACATATCGTTTACTGTTCAAACGATTTGTTGG
GTGACTTGTTTGGTGTACCATCTTTCTCAGTTAAGGAACACAGAAAGATCTATACAATGATATACA
GAAATTTGGTCGTAGGTTCTGGT

5. Trans-Enoyl-CoA Reductase (ECR) – Enzyme Linker – cTPR6 Spacer – ID Linker – ID5 (SEQ ID NO:185)

ATGATCGTAAAGCCAATGGTTAGAAACAACATCTGTTTGAACGCTCATCCTCAAGGTTGCAAAAA
GGGTGTAGAAGATCAAATCGAATACACCAAAAAGAGAATCACTGCAGAAGTTAAAGCCGGTGCT

Figure 14A (continued)

```
AAAGCACCTAAGAATGTTTTGGTCTTAGGTTGTTCCAACGGTTATGGTTTGGCTAGTAGAATAAC
AGCTGCATTTGGTTACGGTGCCGCTACCATCGGTGTTTCCTTCGAAAAGGCTGGTAGTGAAACC
AAATATGGTACTCCAGGTTGGTACAATAACTTGGCATTTGATGAAGCAGCCAAGAGAGAAGGTTT
ATACTCTGTCACTATAGATGGTGACGCTTTCTCAGATGAAATCAAGGCACAAGTTATTGAAGAAG
CCAAAAAGAAAGGTATAAAATTCGATTTGATCGTTTACTCCTTAGCAAGTCCAGTCAGAACAGAT
CCTGACACCGGTATAATGCATAAGTCTGTTTTGAAGCCATTCGGTAAAACTTTCACAGGTAAAAC
AGTCGATCCTTTCACCGGTGAATTGAAAGAAATATCTGCTGAACCAGCAAATGATGAAGAAGCTG
CAGCCACAGTAAAAGTTATGGGTGGTGAAGACTGGGAAAGATGGATCAAGCAATTGTCCAAAGA
AGGTTTGTTGGAAGAAGGTTGTATCACCTTAGCTTATTCATACATTGGTCCTGAAGCCACTCAAG
CTTTGTATAGAAAAGGTACAATCGGTAAAGCTAAAGAACATTTGGAAGCCACCGCTCACAGATTA
AATAAGGAAAACCCATCTATCAGAGCATTTGTTTCTGTAAATAAGGGTTTAGTTACTAGAGCATCC
GCCGTTATCCCAGTCATTCCTTTGTATTTGGCTAGTTTGTTTAAGGTTATGAAGGAAAAGGGTAAC
CATGAAGGTTGCATAGAACAAATCACTAGATTGTACGCAGAAAGATTATACAGAAAGGATGGTAC
AATTCCAGTTGACGAAGAAAACAGAATCAGAATCGATGACTGGGAATTGGAAGAAGATGTCCAAA
AGGCAGTATCTGCCTTAATGGAAAAAGTTACCGGTGAAAACGCTGAATCATTGACTGATTTGGCA
GGTTATAGACACGACTTTTTAGCCTCTAATGGTTTCGATGTCGAAGGTATTAACTACGAAGCAGA
AGTAGAAAGATTCGACAGAATTAAATTGTCTGGTGGTGGTGGTTCTGGTGGTGGTGGTTCTGGT
GGTGGTGGTAGTGCTGAAGCATGGTATAATTTGGGTAACGCTTATTACAAGCAGGGTGACTACC
AAAAGGCCATCGAATACTACCAAAAGGCTTTGGAATTGGACCCTAATAACGCCGAAGCTTGGTA
CAATTTGGGTAATGCCTACTATAAACAGGGTGACTATCAAAAGCAATTGAATATTACCAAAAGG
CCTTGGAATTAGACCCAAATAACGCAGAAGCCTGGTACAATTTGGGTAACGCCTACTATAAGCAG
GGTGACTATCAAAAGGCTATTGAAGACTACCAAAAGGCATTGGAATTAGATCCTAATAACTTGCA
AGCTGAAGCATGGAAAAATTTGGGTAATGCCTATTATAAACAGGGTGACTACCAAAAGCTATTG
AATACTATCAAAAAGCTTTGGAATTGGACCCAAATAACGCCTCAGCTTGGTATAATTTGGGTAAT
GCATACTACAAACAGGGTGACTATCAGAAGGCAATAGAATACTATCAAAAAGCCTTAGAATTGGA
TCCTAATAACGCAAAAGCCTGGTATAGACGTGGTAATGCCTACTACAAGCAGGGTGACTATCAG
AAGGCGATAGAAGATTATCAAAAGGCATTGGAATTGGATCCAAACAACAGATCTAGATCAGCTGG
TGGTGGTGGTTCTGGTGGTGGTGGTTCTGGTGGTGGTGGTGCTTCTTCATATTACCATCACCAT
CACCATCACTTGGAATCCACAAGTTTATATAAGAAAGCAGGTTCTGGTTCAAATTTGTTAGCCACT
TTGAGATCAACAGCTGCAGTATTGGAAAACGAAACCATGTTTTGGAAAAAGAAAAGGAAAAGTT
GAGAAAGGAAAAGGAACAATTGTTGAATAAGTTGGAAGCCTACAAAGGTTCTGCTGGTTCAGCC
GCTGGTTCCGGTGAATTCGGTAGTGCTGAAGCAGCCGCTAAGGAAGCAGCCGCTAAAGCTGGT
TCCGCAGGTAGTGCAGCCGGTTCTGGTGAATTTGGTTCCAGTTACTATCACCATCACCATCATCA
CTTGGAATCCACTAGTTTATATAAGAAAGCTGGTTCTGGTTCAAAGAGAATCGCATACTTGAGAA
AGAAAATCGCTGCATTAAAGAAAGATAACGCCAACTTGGAAAAGGACATCGCTAATTTGGAAAAC
GAAATCGAAAGATTGATTAAAGAAATTAAAACATTAGAAAATGAAGTTGCTTCTCATGAACAAGGT
TCAGGT
```

6. Beta-Ketothiolase (bktB) – Enzyme Linker – cTPR6 Spacer – ID Linker – ID6 (SEQ ID NO:186)

```
ATGACTAGAGAAGTTGTCGTAGTTAGTGGTGTTAGAACAGCTATTGGTACCTTTGGTGGTTCTTT
AAAAGATGTTGCACCAGCCGAATTGGGTGCATTAGTCGTAAGAGAAGCTTTGGCAAGAGCCCAA
GTTTCAGGTGACGATGTCGGTCATGTTGTCTTCGGTAACGTTATCCAAACAGAACCAAGAGATAT
GTATTTGGGTAGAGTAGCTGCAGTTAATGGTGGTGTTACCATAAACGCTCCTGCATTAACTGTCA
ACAGATTGTGTGGTAGTGGTTTACAAGCTATTGTTTCTGCCGCTCAAACAATATTGTTAGGTGAC
ACCGACGTTGCTATCGGTGGTGGTGCTGAATCTATGTCAAGAGCCCCATACTTAGCTCCTGCAG
CCAGATGGGGTGCCAGAATGGGTGACGCTGGTTTGGTTGACATGATGTTGGGTGCTTTGCATGA
TCCATTCCATAGAATCCACATGGGTGTAACTGCAGAAACGTTGCCAAGGAATACGATATCTCAA
GAGCACAACAAGACGAAGCTGCATTAGAATCACACAGAAGAGCATCCGCCGCTATTAAAGCCGG
TTACTTTAAGGATCAAATAGTTCCAGTAGTTTCTAAAGGTAGAAAGGGTGACGTTACCTTCGATAC
```

Figure 14A (continued)

```
TGACGAACATGTTAGACACGACGCTACTATTGATGACATGACAAAGTTAAGACCTGTTTTCGTCA
AGGAAAATGGTACTGTTACAGCTGGTAATGCATCTGGTTTGAACGATGCAGCCGCTGCAGTCGT
AATGATGGAAAGAGCCGAAGCTGAAAGAAGAGGTTTGAAACCATTAGCTAGATTGGTTTCTTATG
GTCATGCTGGTGTCGATCCTAAAGCAATGGGTATAGGTCCAGTTCCTGCTACTAAGATCGCATTG
GAAAGAGCCGGTTTACAAGTCTCTGATTTGGACGTAATTGAAGCCAATGAAGCTTTTGCCGCTCA
AGCATGTGCCGTTACAAAAGCCTTGGGTTTAGATCCAGCTAAGGTCAATCCTAACGGTAGTGGT
ATCTCTTTAGGTCATCCAATTGGTGCAACCGGTGCCTTGATAACTGTTAAGGCTTTGCACGAATT
GAACAGAGTACAAGGTAGATATGCATTAGTTACAATGTGCATCGGTGGTGGTCAAGGTATTGCA
GCCATATTCGAAAGAATTAAGTTGTCTGGTGGTGGTGGTTCTGGTGGTGGTGGTTCTGGTGGTG
GTGGTAGTGCTGAAGCATGGTACAATTTGGGTAACGCTTACTACAAGCAGGGTGACTACCAAAA
GGCAATCGAATATTACCAAAAAGCCTTGGAATTAGACCCAAATAACGCCGAAGCTTGGTATAATT
TGGGTAATGCCTATTATAAACAGGGTGACTATCAAAAAGCTATAGAATACTACCAAAAGGCATTG
GAATTAGACCCTAATAACGCAGAAGCCTGGTATAATTTGGGTAACGCCTATTATAAGCAGGGTGA
CTATCAAAAGGCCATAGAAGACTACCAAAAGGCTTTGGAATTGGATCCAAACAACTTACAAGCTG
AAGCATGGAAGAATTTGGGTAACGCTTATTACAAACAGGGTGACTACCAAAAAGCTATTGAATAC
TATCAAAAGGCTTTAGAATTGGACCCTAATAACGCCTCTGCTTGGTACAATTTGGGTAATGCCTA
CTATAAACAGGGTGACTACCAGAAGGCTATCGAATATTATCAAAAAGCTTTAGAATTGGACCCAA
ATAACGCAAAGGCCTGGTACAGACGTGGTAATGCCTATTACAAGCAGGGTGACTACCAGAAAGC
TATTGAAGATTATCAAAAGGCATTGGAATTGGATCCTAACAACAGATCCAGAAGTGCTGGTGGTG
GTGGTTCTGGTGGTGGTGGTTCTGGTGGTGGTGGTGCTTCTGATGTTATGTGGGAATATAAGTG
GGAAAATACAGGTGACGCTGAATTATACGGTCCTTTTACTTCAGCACAAATGCAAACATGGGTAT
CCGAAGGTTATTTCCCTGATGGTGTTTACTGCAGAAAATTAGACCCACCTGGTGGTCAATTCTAC
AACTCAAAGAGAATAGATTTCGACTTGTACACCGGTTCAGCTGGTTCCGCTGCAGGTTCTGGTG
AATTTGGTTCCGCAGAAGCCGCTGCAAAAGAAGCCGCTGCAAAGGCTGGTAGTGCAGGTTCTG
CCGCTGGTAGTGGTGAATTTGGTTCTGAATCAGATTCCGTCGAATTCAATAACGCTATATCTTAC
GTAAATAAGATTAAAACCAGATTTTTAGATCATCCAGAAATCTATAGATCATTCTTAGAAATCTTGC
ATACATACCAAAAAGAACAATTGCACACCAAGGGTAGACCTTTCAGAGGCATGTCCGAAGAAGA
AGTCTTTACTGAAGTAGCTAATTTGTTTAGAGGTCAAGAAGATTTGTTGTCAGAATTCGGTCAATT
CTTGCCAGAAGCAAAAGAGGTTCCGGT
```

7. <u>Hexanoyl-CoA Synthetase (HCS) (SEQ ID NO:187)</u>

```
ATGGGTAAAAATTACAAGTCATTGGATTCCGTTGTCGCAAGTGACTTTATTGCCTTGGGTATAACT
TCTGAAGTCGCAGAAACATTGCATGGTAGATTAGCCGAAATTGTATGTAACTACGGTGCTGCAAC
CCCACAAACTTGGATCAACATAGCAAACCATATCTTGTCACCAGATTTGCCTTTCTCCTTGCACC
AAATGTTGTTTATGGTTGCTACAAGGATTTCGGTCCTGCTCCACCTGCATGGATTCCAGACCCT
GAAAAGGTTAAGTCAACTAATTTGGGTGCTTTGTTAGAAAAGAGAGGTAAAGAATTCTTGGGTGT
TAAGTACAAGGATCCAATCTCTTCTTTTTCTCACTTCCAAGAATTTTCTGTCAGAAACCCTGAAGT
ATACTGGAGAACAGTTTTGATGGATGAAATGAAAATAAGTTTCTCTAAGGACCCAGAATGTATCTT
GAGAAGAGATGACATCAACAACCCAGGTGGTTCTGAATGGTTGCCAGGTGGTTATTTGAACTCA
GCTAAAAATTGCTTGAACGTTAACTCCAATAAGAAATTGAATGATACTATGATTGTCTGGAGAGAT
GAAGGCAACGATGACTTGCCATTGAATAAGTTGACATTGGATCAATTGAGAAAGAGAGTTTGGTT
GGTCGGTTACGCATTAGAAGAAATGGGTTTGGAAAAAGGTTGTGCCATAGCTATCGATATGCCTA
TGCATGTAGACGCTGTAGTTATCTATTTGGCTATTGTTTTAGCAGGTTACGTCGTAGTTTCTATAG
CTGATTCATTTTCCGCACCAGAAATCTCAACTAGATTGAGATTATCCAAAGCAAAGGCCATATTCA
CACAAGATCACATCATCAGAGGTAAAAAGAGAATCCCTTTATACTCAAGAGTCGTAGAAGCCAAA
TCCCCAATGGCTATAGTTATCCCTTGTAGTGGTTCTAACATTGGTGCAGAATTAAGAGATGGTGA
CATATCTTGGGATTACTTTTGGAAAGAGCCAAAGAATTCAAGAATTGCGAATTCACTGCCAGAG
AACAACCAGTTGATGCTTACACTAACATTTTGTTCTCCAGTGGTACTACAGGTGAACCAAAAGCA
ATACCTTGGACACAAGCCACCCCTTTAAAGGCCGCTGCAGATGGTTGGTCACATTTGGATATTAG
```

Figure 14A (continued)

```
AAAAGGTGACGTCATAGTATGGCCAACTAATTTGGGTTGGATGATGGGTCCTTGGTTGGTTTATG
CTAGTTTGTTAAATGGTGCCTCTATTGCTTTATACAACGGTAGTCCATTGGTTTCTGGTTTCGCTA
AATTTGTCCAAGATGCAAAAGTAACAATGTTGGGTGTTGTCCCTTCAATCGTTAGAAGTTGGAAG
TCTACAAATTGTGTCTCAGGTTATGATTGGTCCACCATCAGATGCTTTTCTTCATCCGGTGAAGC
CTCTAATGTCGACGAATATTTGTGGTTAATGGGTAGAGCTAACTACAAGCCAGTTATCGAAATGT
GTGGTGGTACCGAAATTGGTGGTGCATTCTCAGCCGGTTCCTTTTACAAGCTCAATCATTGAGT
TCTTTTTCATCCCAATGTATGGGTTGCACATTGTACATCTTGGATAAGAACGGTTACCCAATGCCT
AAAAATAAGCCAGGTATTGGTGAATTGGCTTTAGGTCCTGTTATGTTCGGTGCATCTAAAACATT
GTTGAACGGTAACCATCACGATGTATACTTCAAGGGTATGCCAACCTTAAATGGTGAAGTTTTGA
GAAGACATGGTGACATATTCGAATTAACCTCAAACGGTTACTACCATGCCCACGGTAGAGCTGAT
GACACTATGAACATCGGTGGTATCAAAATCAGTTCTATCGAAATCGAAAGAGTATGTAACGAAGT
TGATGACAGAGTCTTTGAAACCACTGCAATTGGTGTTCCACCATTGGGTGGTGGTCCAGAACAAT
TAGTAATCTTTTTCGTTTTGAAGGATTCTAACGACACAACCATAGATTTGAACCAATTGAGATTAT
CTTTTAACTTGGGTTTACAAAAGAAATTGAACCCATTATTCAAAGTTACTAGAGTAGTTCCATTGT
CATCCTTACCTAGAACTGCTACAAACAAGATTATGAGAAGAGTCTTGAGACAACAATTCAGTCATT
TTGAAGGTTCTGGT
```

Figure 14B

Codon-optimized GPP Gene Cassette Nucleotide Sequences

1. <u>HMG-CoA Synthase (HMGS) – Enzyme Linker – cTPR6 Spacer – ID Linker – ID7 (SEQ ID NO:188)</u>

```
ATGAAGTTATCTACTAAATTGTGTTGGTGCGGTATTAAGGGTAGATTAAGACCACAAAAGCAACA
ACAATTGCATAACACAAACTTGCAAATGACCGAATTGAAGAAACAAAAGACTGCTGAACAAAAGA
CTAGACCACAAAACGTTGGTATTAAAGGTATCCAAATCTATATCCCTACACAATGTGTCAATCAAT
CTGAATTGGAAAAGTTTGATGGTGTATCACAGGGTAAATACACTATCGGTTTAGGTCAAACAAAC
ATGTCTTTCGTAAACGATAGAGAAGACATCTATTCTATGTCATTGACTGTTTTGTCCAAGTTGATA
AAAAGTTACAACATCGATACAAACAAGATTGGTAGATTGGAAGTTGGTACCGAAACTTTGATCGA
TAAGTCCAAGAGTGTCAAGTCTGTATTGATGCAATTGTTCGGTGAAAATACCGATGTTGAAGGTA
TCGACACTTTAAATGCTTGTTATGGTGGTACTAACGCATTATTCAATTCATTGAACTGGATCGAAT
CCAATGCCTGGGATGGTAGAGATGCTATTGTTGTCTGCGGTGACATCGCTATCTATGACAAAGG
TGCTGCAAGACCAACCGGTGGTGCAGGTACTGTTGCCATGTGGATAGGTCCAGATGCACCTATC
GTTTTTGACTCTGTCAGAGCATCATACATGGAACATGCCTACGATTTCTACAAACCAGACTTCAC
CTCCGAATATCCTTACGTTGATGGTCACTTTTCTTTGACTTGTTACGTCAAGGCTTTGGACCAAGT
ATACAAGTCTTACTCTAAGAAAGCAATATCTAAGGGTTTGGTTTCAGATCCAGCTGGTTCCGACG
CATTAAACGTCTTGAAGTACTTCGATTACAACGTTTTCCATGTCCCTACATGCAAGTTGGTTACCA
AGTCTTACGGTAGATTGTTGTACAACGATTTCAGAGCTAACCCACAATTGTTCCCTGAAGTCGAC
GCTGAATTAGCAACTAGAGATTACGACGAATCTTTGACAGATAAGAACATCGAAAAGACTTTCGT
AAACGTTGCAAAGCCATTCCACAAAGAAAGAGTTGCCCAATCATTAATTGTCCCTACAAATACCG
GTAACATGTATACAGCCTCAGTTTACGCCGCTTTTGCTTCCTTGTTAAATTATGTAGGTAGTGATG
ACTTGCAAGGTAAAGAGTTGGTTTATTCTCCTATGGTAGTGGTTTAGCAGCCTCTTTGTACTCTT
GTAAGATTGTAGGTGACGTTCAACACATTATTAAGGAATTGGACATCACTAATAAGTTGGCTAAG
AGAATCACTGAAACACCAAAGGATTATGAAGCTGCAATCGAATTGAGAGAAAACGCACATTTGAA
GAAAAATTTCAAACCTCAAGGTAGTATAGAACACTTGCAATCTGGTGTCTACTACTTAACAAACAT
CGATGACAAATTCAGAAGATCATACGATGTTAAAAGAAATTGTCTGGTGGTGGTGGTTCTGGTG
GTGGTGGTTCTGGTGGTGGTGGTAGTGCTGAAGCATGGTATAATTTGGGTAACGCTTATTACAA
GCAGGGTGACTACCAAAAAGCAATCGAATATTACCAAAAGGCCTTGGAATTAGACCCAAATAACG
CCGAAGCTTGGTACAATTTGGGTAATGCATACTATAAACAGGGTGACTATCAAAAGGCTATCGAA
TACTACCAAAAGGCATTGGAATTAGACCCTAATAACGCAGAAGCCTGGTACAATTTGGGTAACGC
```

Figure 14B (continued)

CTACTATAAGCAGGGTGACTATCAAAAAGCCATAGAAGACTACCAAAAGGCTTTGGAATTAGATC
CAAATAACTTGCAAGCTGAAGCATGGAAAAATTTGGGTAATGCCTACTACAAACAGGGTGACTAC
CAAAAGGCAATTGAATATTATCAAAAAGCCTTGGAATTAGATCCTAATAACGCCTCAGCTTGGTAT
AATTTGGGTAATGCCTATTATAAGCAGGGTGACTACCAGAAAGCCATTGAATATTATCAAAAGGC
TTTAGAATTGGATCCAAATAACGCAAAAGCCTGGTATAGACGTGGTAATGCCTACTACAAGCAGG
GTGACTATCAGAAGGCTATTGAAGATTATCAAAAAGCTTTGGAATTGGATCCAAACAACAGATCC
AGAAGTGCTGGTGGTGGTGGTTCTGGTGGTGGTGGTTCTGGTGGTGGTGGTGCTTCTTTGGGT
CCTTTGCCACCTGGTTGGGAAGTAAGATCCACAGTTAGTGGTAGAATCTATTTCGTTGATCATAA
CAACAGAACTACACAATTCACCGACCCAAGATTGCACGGTTCTGCTGGTTCAGCCGCTGGTTCT
GGTGAATTTGGTTCCGCAGAAGCAGCCGCTAAGGAAGCAGCCGCTAAAGCCGGTTCCGCTGGT
AGTGCAGCCGGTAGTGGTGAATTTGGTTCTGGTGCTATGGGTCCATTACCACCTGGTTGGGAAA
AGAGAACAGATTCTAACGGTAGAGTCTACTTCGTAAACCATAATACCAGAATTACTCAATGGGAA
GATCCTAGATCTGGTTCAGGT

2. <u>Truncated HMG-CoA Reductase (tHMGR) – Enzyme Linker – cTPR6 Spacer – ID Linker – ID8 (SEQ ID NO:189)</u>

ATGGTAGCCGTTAGAAGAAAGGCTTTGTCTATCTTAGCCGAAGCTCCAGTTTTGGCATCAGATAG
ATTACCTTACAAGAACTACGATTACGACAGAGTATTTGGTGCTTGTTGCGAAAACGTTATTGGTTA
TATGCCATTGCCTGTCGGTGTAATCGGTCCATTAGTTATTGATGGTACATCTTACCATATCCCTAT
GGCAACTACAGAAGGTTGTTTGGTTGCATCAGCCATGAGAGGTTGCAAGGCAATTAATGCTGGT
GGTGGTGCTACCACTGTTTTAACCAAAGATGGTATGACTAGAGGTCCAGTTGTCAGATTTCCTAC
TTTGAAGAGATCCGGTGCTTGTAAAATATGGTTAGATAGTGAAGAAGGTCAAAATGCCATCAAAA
AGGCTTTTAACTCCACTAGTAGATTCGCAAGATTGCAACATATTCAAACATGCTTAGCCGGTGAC
TTGTTGTTTATGAGATTCAGAACAACCACTGGTGACGCTATGGGTATGAATATGATATCTAAGGG
TGTCGAATACTCATTGAAGCAAATGGTAGAAGAATACGGTTGGGAAGATATGGAAGTAGTTTCTG
TTTCAGGCAACTACTGTACTGACAAAAAGCCAGCTGCAATTAACTGGATAGAAGGTCGTGGTAAA
TCTGTCGTAGCTGAAGCAACAATACCTGGTGACGTTGTTAGAAAGGTTTTGAAATCTGACGTATC
AGCTTTGGTTGAATTGAACATCGCTAAAAATTTGGTTGGTTCCGCCATGGCTGGTAGTGTCGGTG
GTTTTAATGCACATGCCGCTAACTTAGTTACAGCAGTCTTCTTGGCCTTAGGTCAAGATCCAGCT
CAAAACGTAGAATCTTCAAACTGTATCACCTTGATGAAAGAAGTTGATGGTGACTTAAGAATATCC
GTTAGTATGCCATCAATAGAAGTCGGTACAATCGGTGGTGGTACCGTCTTGGAACCTCAAGGTG
CAATGTTAGATTTGTTAGGTGTTAGAGGTCCACATGCAACTGCCCCTGGTACAAATGCTAGACAA
TTGGCAAGAATTGTCGCTTGTGCAGTATTAGCTGGTGAATTGTCCTTATGCGCAGCCTTGGCTGC
AGGTCACTTAGTTCAAAGTCATATGACACACAACAGAAAGTTGTCTGGTGGTGGTGGTTCTGGTG
GTGGTGGTTCTGGTGGTGGTGGTAGTGCCGAAGCTTGGTATAATTTGGGTAACGCATATTACAA
GCAGGGTGACTACCAAAAGGCCATCGAATACTACCAAAAGGCTTTGGAATTGGACCCAAATAAC
GCAGAAGCCTGGTACAATTTGGGTAATGCTTACTATAAACAGGGTGACTATCAAAAGGCAATTGA
ATATTACCAAAAGGCCTTGGAATTAGACCCTAATAACGCTGAAGCATGGTACAATTTGGGTAACG
CCTACTATAAGCAGGGTGACTATCAAAAGCTATTGAAGACTACCAAAAGGCATTGGAATTAGAT
CCAAATAACTTGCAAGCCGAAGCTTGGAAAAATTTGGGTAACGCTTACTACAAACAGGGTGACTA
CCAAAAAGCTATTGAATACTATCAAAAGCTTTGGAATTGGACCCTAATAACGCATCTGCCTGGT
ATAATTTGGGTAATGCTTATTATAAACAGGGTGACTACCAGAAGGCAATAGAATACTATCAAAAG
CCTTGGAATTAGACCCAAATAACGCTAAAGCATGGTATAGACGTGGTAATGCTTACTATAAGCAG
GGTGACTACCAGAAAGCTATAGAAGATTATCAAAAGGCATTGGAATTGGATCCTAACAACAGATC
TAGATCAGCTGGTGGTGGTGGTTCTGGTGGTGGTGGTTCTGGTGGTGGTGGTGCTTCCAGTTAT
TACCATCACCATCACCATCACTTGGAATCCACTAGTTTATACAAAAAGGCAGGTTCAGAATTTTTC
AGAAGAGAAAGAAATAAGATGGCCGCTGCAAAATGTAGAAACAGAAGAAGAGAATTGACAGATA
CCTTACAAGCTGAAACCGATCAATTGGAAGACGAAAAGTCTGCATTGCAAACTGAAATAGCCAAT
TTGTTGAAGGAAAAGGAAAAGTTGGAATTCATTTTAGCCGCTCATAGACCAGCTTGCAAAATTCC

Figure 14B (continued)

TGATGACTTGGGTTTCCCAGAAGAAATGTCTTTAGAAGGTTCCGCAGGTAGTGCAGCCGGTTCC
GGTGAATTTGGTAGTGCTGAAGCTGCAGCCAAGGAAGCTGCAGCCAAAGCTGGTTCTGCAGGTT
CAGCTGCAGGTTCCGGTGAATTCGGTTCTTCATACTATCACCATCACCATCATCACTTGGAATCT
ACCTCATTATACAAAAAGGCTGGTTCCGGTAGTCAAAAGGTTGAATCTTTGAAGCAAAGATTGA
AGAATTGAAGCAAAGAAAAGCCCAATTGAAGAATGATATCGCTAACTTAGAAAAGGAAATCGCCT
ACGCTGAAACTGGTTCTGGT

3. Mevalonate Kinase (ERG12) – Enzyme Linker – cTPR6 Spacer – ID Linker – ID9 (SEQ ID NO:190)

ATGAGTTTACCATTTTTGACATCTGCTCCTGGTAAAGTTATTATATTCGGTGAACATAGTGCCGTC
TATAATAAGCCAGCTGTCGCTGCATCTGTATCAGCTTTGAGAACATACTTGTTGATCTCTGAATCT
TCAGCACCTGATACCATCGAATTGGATTTCCCAGACATCTCATTCAATCACAAGTGGTCCATTAAT
GATTTCAACGCTATCACCGAAGACCAAGTAAACTCACAAAAGTTGGCCAAAGCTCAACAAGCAAC
TGATGGTTTGTCACAAGAATTAGTTTCCTTGTTAGACCCATTGTTGGCTCAATTGTCCGAAAGTTT
CCATTACCACGCCGCTTTCTGTTTCTTGTACATGTTCGTTTGTTTATGCCCTCATGCTAAGAATAT
CAAATTTTCTTTGAAGTCTACTTTGCCAATTGGTGCAGGTTTAGGTTCCAGTGCCTCTATATCAGT
TTCCTTAGCATTGGCCATGGCTTATTTGGGTGGTTTGATAGGTAGTAACGATTTGGAAAAGTTGT
CTGAAAACGACAAGCATATCGTCAACCAATGGGCATTCATCGGTGAAAAATGCATTCACGGTACT
CCTAGTGGTATAGATAATGCAGTTGCCACATATGGTAACGCTTTGTTATTCGAAAAGGACTCTCA
TAACGGTACCATCAACACTAACAACTTCAAGTTCTTGGATGACTTTCCTGCAATACCAATGATCTT
GACTTACACAAGAATTCCAAGATCTACTAAAGATTTGGTAGCTAGAGTCAGAGTATTGGTTACAG
AAAAGTTCCCTGAAGTTATGAAGCCAATCTTGGATGCAATGGGTGAATGTGCCTTGCAAGGTTTG
GAAATCATGACAAAGTTGTCAAAGTGCAAGGGTACTGATGACGAAGCTGTTGAAACAAATAACGA
ATTGTACGAACAATTGTTGGAATTGATCAGAATCAATCATGGTTTGTTAGTTTCAATTGGTGTCTC
CCACCCAGGTTTAGAATTGATAAAGAACTTGTCAGATGACTTAAGAATCGGTTCCACAAAATTGA
CCGGTGCTGGTGGTGGTGGTTGTTCTTTGACCTTGTTAAGAAGAGATATCACTCAAGAACAAATC
GACAGTTTTAAAAAGAAATTGCAAGATGACTTCTCTTACGAAACTTTCGAAACAGATTTGGGTGGT
ACTGGTTGTTGCTTGTTGTCAGCTAAGAATTTGAACAAAGATTTGAAGATTAAATCCTTGGTTTTC
CAATTGTTCGAAAATAAGACTACAACCAAGCAACAAATCGATGACTTGTTGTTGCCTGGTAATAC
AAACTTGCCATGGACCTCAAAATTATCTGGTGGTGGTGGTTCTGGTGGTGGTGGTTCTGGTGGT
GGTGGTAGTGCTGAAGCATGGTATAATTTGGGTAACGCATATTACAAGCAGGGTGACTACCAAA
AGGCTATCGAATACTACCAAAAGGCATTGGAATTGGACCCTAATAACGCCGAAGCTTGGTACAAT
TTGGGTAATGCTTACTATAAACAGGGTGACTATCAAAAGGCCATTGAATATTACCAAAAGGCTTT
GGAATTGGACCCAAATAACGCAGAAGCCTGGTACAATTTGGGTAACGCTTACTATAAGCAGGGT
GACTATCAAAAAGCAATTGAAGACTACCAAAAGGCCTTAGAATTGGATCCTAATAACTTGCAAGC
TGAAGCATGGAAAAATTTGGGTAACGCTTATTATAAACAGGGTGACTACCAAAAGCCATTGAAT
ACTATCAAAAGCATTGGAATTGGATCCAAATAACGCCTCTGCTTGGTATAATTTGGGTAATGCTT
ATTATAAGCAGGGTGACTACCAGAAAGCCATAGAATACTATCAAAAAGCTTTGGAATTAGACCCT
AATAACGCAAAAGCCTGGTATAGACGTGGTAATGCTTACTACAAACAGGGTGACTATCAGAAGG
CAATAGAAGATTATCAAAAAGCTTTAGAATTAGACCCAAATAACAGAAGTAGATCTGCTGGTGGT
GGTGGTTCTGGTGGTGGTGGTTCTGGTGGTGGTGGTGCTTCTATGGAACCTGCAATGGAACCA
GAAACATTGGAAGCCAGAATCAATAGAGCTACCAATCCTTTGAACAAGGAATTGGATTGGGCTTC
TATTAATGGTTTCTGTGAACAATTGAACGAAGACTTCGAAGGTCCACCTTTAGCAACAAGATTATT
GGCCCATAAAATTCAATCACCACAAGAATGGGAAGCAATACAAGCCTTAACCGTCTTGGAAACTT
GTATGAAGTCCTGCGGTAAAAGATTCCACGATGAAGTTGGTAAATTCAGATTTTTGAACGAATTG
ATCAAGGTTGTCTCACCTAAGTATTTGGGTAGTAGAACATCTGAAAAGGTTAAAAACAAGATCTT
GGAATTGTTGTACTCCTGGACCGTAGGTTTACCAGAAGAAGTTAAGATCGCTGAAGCATACCAAA
TGTTGAAGAAACAAGGTATTGTTAAGTCAGGTTCCGCCGGTAGTGCAGCCGGTTCTGGTGAATT
CGGTTCTGCAGAAGCTGCAGCCAAGGAAGCTGCAGCCAAAGCTGGTTCAGCAGGTTCCGCTGC
AGGTTCTGGTGAATTTGGTTCAGGTGCAATGGGTTCCATGGCCGAAGCTGAAGGTGAAAGTTTG

Figure 14B (continued)

GAATCTTGGTTAAATAAGGCTACAAATCCATCAAACAGACAAGAAGATTGGGAATATATCATTGG
TTTCTGTGACCAAATCAATAAGGAATTGGAAGGTCCTCAAATAGCTGTTAGATTATTGGCACATAA
GATCCAATCTCCACAAGAATGGGAAGCCTTACAAGCTTTGACTGTTTAGAAGCTTGTATGAAGA
ATTGCGGTAGAAGATTTCACAACGAAGTCGGTAAATTCAGATTTTTGAATGAATTAATTAAGGTAG
TTAGTCCAAAATACTTAGGTGACAGAGTTTCTGAAAAGGTTAAGACCAAAGTCATAGAATTGTTGT
ACTCTTGGACTATGGCCTTGCCTGAAGAAGCTAAGATCAAAGATGCATACCATATGTTGAAGAGA
CAAGGTATAGTCCAATCAGATCCACCTATCCCAGTAGACAGAACTTTGATTCCATCTCCACCACC
AAGACCTAAAAATGGTTCCGGT

4. Phosphomevalonate Kinase (ERG8) – Enzyme Linker – cTPR6 Spacer – ID Linker – ID10 (SEQ ID NO:191)

ATGTCCGAATTAAGAGCTTTTAGTGCACCTGGTAAAGCCTTGTTAGCTGGTGGTTATTTGGTTTT
GGATACAAAGTACGAAGCATTCGTTGTCGGTTTGTCAGCCAGAATGCATGCAGTCGCCCACCCT
TACGGTTCTTTACAAGGTTCTGATAAGTTCGAAGTAAGAGTCAAGTCTAAGCAATTCAAGGACGG
TGAATGGTTATACCATATATCTCCAAAGTCAGGTTTTATTCCTGTTTCCATAGGTGGTAGTAAAAA
TCCATTCATCGAAAAGGTTATTGCAAACGTCTTTTCTTACTTCAAGCCTAACATGGATGACTACTG
TAACAGAAACTTGTTCGTCATCGATATATTCTCTGATGACGCTTATCATTCTCAAGAAGACTCAGT
AACTGAACACAGAGGTAATAGAAGATTGTCCTTTCATAGTCACAGAATTGAAGAAGTTCCAAAAA
CCGGTTTAGGTTCTTCAGCTGGTGGTTTAGTCACTGTATTGACTACAGCTTTAGCATCCTTTTCG
TTAGTGATTTGGAAAACAACGTAGACAAGTACAGAGAAGTTATTCATAATTTGGCACAAGTAGCC
CACTGCCAAGCACAAGGTAAAATCGGTTCCGGTTTTGATGTTGCTGCAGCCGCTTATGGTTCAAT
TAGATACAGAAGATTCCCACCTGCTTTGATATCTAATTTGCCAGATATCGGTTCTGCTACATATGG
TTCAAAGTTGGCACATTTGGTTGATGAAGAAGACTGGAACATCACAATTAAATCCAACCATTTGC
CTAGTGGTTTGACCTTATGGATGGGTGACATTAAGAATGGTTCTGAAACTGTTAAGTTGGTCCAA
AAAGTAAAGAACTGGTACGATTCTCATATGCCAGAATCATTGAAGATCTACACAGAATTAGACCA
TGCTAATTCCAGATTCATGGATGGTTTGAGTAAATTAGACAGATTGCATACCCACGATGACTACT
CTGATCAAATCTTCGAATCATTGGAAAGAAACGACTGTACTTGCCAAAAATACCCAGAAATCACA
GAAGTAAGAGATGCCGTTGCTACCATAAGAAGATCTTTTAGAAAGATCACTAAGGAATCAGGTGC
AGATATCGAACCACCTGTTCAAACATCTTTGTTAGATGACTGTCAAACCTTGAAGGGTGTCTTAA
CTTGCTTGATTCCAGGTGCTGGTGGTTATGATGCAATAGCCGTCATCACTAAACAAGATGTAGAC
TTGAGAGCTCAAACAGCAAACGATAAGAGATTTTCAAAGGTCCAATGGTTAGATGTAACCCAAGC
TGACTGGGGTGTTAGAAAAGAAAAGGATCCTGAAACTTACTTGGACAAAAAGTTATCTGGTGGTG
GTGGTTCTGGTGGTGGTGGTTCTGGTGGTGGTGGTAGTGCTGAAGCATGGTACAATTTGGGTAA
CGCATACTACAAGCAGGGTGACTACCAAAAGGCCATAGAATACTACCAAAAGGCTTTGGAATTG
GACCCAAATAACGCCGAAGCTTGGTATAATTTGGGTAATGCTTATTATAAACAGGGTGACTATCA
AAAGGCAATCGAATACTACCAAAAGGCCTTGGAATTAGACCCTAATAACGCAGAAGCCTGGTATA
ATTTGGGTAACGCTTATTATAAGCAGGGTGACTATCAAAAAGCTATCGAAGACTACCAAAAGGCA
TTGGAATTAGATCCAAATAACTTGCAAGCTGAAGCATGGAAGAATTTGGGTAACGCTTACTATAA
ACAGGGTGACTACCAAAAGCCATTGAATATTATCAAAAAGCTTTGGAATTGGATCCTAATAACG
CCTCTGCTTGGTACAATTTGGGTAATGCTTACTATAAGCAGGGTGACTATCAGAAGGCTATTGAA
TATTATCAAAAGGCTTTAGAATTGGACCCTAATAACGCAAAGGCCTGGTACAGACGTGGTAACGC
TTATTACAAACAGGGTGACTACCAGAAAGCTATTGAAGATTATCAAAAGGCATTGGAATTGGATC
CTAACAACAGATCCAGAAGTGCTGGTGGTGGTGGTTCTGGTGGTGGTGGTTCTGGTGGTGGTG
GTGCTTCCAGTTATTACCATCACCATCACCATCACTTGGAATCTACATCATTATACAAAAAGGCTG
GTTCCGGTAGTCAAAAGGTTGAAGAATTGAAAAATAAGATAGCCGAATTGGAAAACAGAAACGCT
GTTAAAAAGAACAGAGTCGCACATTTGAAACAAGAAATAGCCTACTTGAAGGATGAATTAGCAGC
CCATGAATTTGAAGGTTCTGCCGGTTCAGCTGCAGGTTCTGGTGAATTCGGTTCAGCTGAAGCC
GCTGCAAAAGAAGCCGCTGCAAAGGCCGGTTCCGCTGGTAGTGCCGCTGGTTCTGGTGAATTT
GGTTCTTCATACTATCACCATCACCATCATCACTTGGAATCTACTTCATTATATAAAAAGGCCGGT

Figure 14B (continued)

TCCGGTAGTTTCGAAAACGTTACACATGAATTCATTTTGGCTACCTTGGAAAACGAAAACGCAAA
GTTAAGAAGATTGGAAGCCAAGTTGGAAAGAGAATTAGCTAGATTGAGAAATGAAGTTGCATGGT
TAGGTTCTGGT

5. <u>Diphosphomevalonate Decarboxylase (MVD1) – Enzyme Linker – cTPR6 Spacer – ID Linker – ID11</u>
   (SEQ ID NO:192)

ATGACAGTTTATACCGCTTCTGTCACCGCACCTGTAAATATTGCTACTTTGAAATACTGGGGTAAA
AGAGATACTAAGTTGAATTTGCCAACAAACTCTTCAATCTCAGTTACATTGTCCCAAGATGACTTA
AGAACCTTGACTTCTGCTGCAACTGCTCCTGAATTCGAAAGAGATACATTGTGGTTGAATGGTGA
ACCACATTCTATCGACAACGAAAGAACTCAAAACTGTTTGAGAGATTTGAGACAATTGAGAAAGG
AAATGGAGAGTAAGGATGCTTCTTTGCCTACATTGAGTCAATGGAAGTTGCACATAGTTTCTGAA
AACAACTTCCCAACCGCCGCTGGTTTGGCATCCAGTGCAGCCGGTTTCGCTGCATTAGTCTCTG
CAATCGCCAAGTTGTACCAATTGCCACAAAGTACATCTGAAATCAGTAGAATCGCTAGAAAAGGT
TCAGGTTCCGCATGTAGATCTTTATTTGGTGGTTACGTCGCATGGGAAATGGGTAAAGCCGAAG
ACGGTCATGATTCAATGGCCGTACAAATAGCTGACTCTTCAGATTGGCCTCAAATGAAAGCTTGC
GTCTTGGTTGTCTCAGACATCAAAAAGGATGTATCCAGTACACAAGGCATGCAATTGACTGTTGC
AACATCCGAATTGTTTAAAGAAAGAATCGAACACGTAGTTCCAAAAAGATTCGAAGTCATGAGAA
AGGCTATCGTAGAAAAGGATTTCGCCACCTTCGCTAAGGAAACTATGATGGACAGTAACTCTTTC
CATGCAACTTGTTTGGATTCATTTCCACCTATTTTCTATATGAACGACACCTCAAAGAGAATAATC
TCCTGGTGCCACACTATCAACCAATTCTACGGTGAAACAATCGTTGCTTACACCTTCGATGCAGG
TCCTAATGCCGTCTTGTATTACTTAGCCGAAAACGAATCAAAGTTGTTCGCTTTTATATATAAGTT
GTTTGGTTCCGTTCCAGGTTGGGATAAAAAGTTCACTACAGAACAATTGGAAGCTTTTAATCATC
AATTCGAATCTTCAAACTTTACTGCCAGAGAATTGGACTTAGAATTGCAAAAGGATGTAGCTAGA
GTTATCTTGACCCAAGTTGGTTCAGGTCCTCAAGAAACTAACGAATCCTTGATAGATGCTAAGAC
AGGTTTGCCAAAAGAAAAATTGTCTGGTGGTGGTGGTTCTGGTGGTGGTGGTTCTGGTGGTGGT
GGTAGTGCTGAAGCATGGTATAATTTGGGTAACGCTTATTACAAGCAGGGTGACTACCAAAAGG
CCATCGAATACTACCAAAAGGCTTTGGAATTGGACCCTAATAACGCCGAAGCTTGGTACAATTTG
GGTAATGCCTACTATAAACAGGGTGACTATCAAAAGCAATTGAATATTACCAAAAGGCCTTGGA
ATTGGACCCAAATAACGCAGAAGCCTGGTACAATTTGGGTAACGCCTACTATAAGCAGGGTGAC
TATCAAAAGGCTATCGAAGATTACCAAAAGGCATTAGAATTGGATCCTAATAACTTGCAAGCTGA
AGCATGGAAAAATTTGGGTAATGCCTATTATAAACAGGGTGACTACCAAAAGCTATTGAATACT
ATCAAAAAGCTTTAGAATTAGACCCAAATAACGCCTCAGCTTGGTATAATTTGGGTAATGCATACT
ACAAACAGGGTGACTATCAGAAGGCAATTGAATACTATCAAAAGGCATTAGAATTAGATCCTAAT
AACGCAAAAGCCTGGTATAGACGTGGTAATGCCTACTACAAGCAGGGTGACTATCAGAAGGCGA
TTGAAGACTACCAAAAGGCATTGGAATTGGATCCAAACAACAGATCAAGATCCGCTGGTGGTGG
TGGTTCTGGTGGTGGTGGTTCTGGTGGTGGTGGTGCTTCTGCAATGGCCGATTTGGAACAAAAG
GTATTGGAAATGGAAGCTAGTACATATGACGGTGTTTTTATTTGGAAGATCTCTGATTTCCCAAGA
AAAAGACAAGAAGCTGTTGCAGGTAGAATCCCTGCTATTTTTAGTCCAGCATTCTACACCTCTAG
ATACGGTTACAAGATGTGTTTGAGAATATATTTGAATGGTGACGGTACTGGTAGAGGTACTCATT
TGTCTTTGTTTTTCGTCGTAATGAAGGGTCCTAATGATGCTTTGTTGAGATGGCCTTTTAATCAAA
AGGTTACCTTGATGTTGTTGGATCAAAACAACAGAGAACACGTTATCGACGCTTTTAGACCTGAT
GTCACTTCCAGTTCTTTCCAAAGACCAGTTAATGATATGAACATTGCTTCTGGTTGTCCTTTGTTT
TGCCCAGTCTCAAAGATGGAAGCTAAAAATTCCTATGTTAGAGATGACGCCATCTTCATTAAGGC
TATCGTTGATTTGACTGGTTTAGGTTCAGCAGGTTCCGCCGCTGGTTCTGGTGAATTTGGTTCCG
CCGAAGCAGCCGCTAAGGAAGCAGCCGCTAAAGCAGGTAGTGCCGGTTCTGCAGCCGGCTCTG
GCGAATTTGGTAGTGCCTCTATTAAATTGCAATCATCCGACGGTGAAATCTTCGAAGTTGATGTC
GAAATAGCAAAGCAATCTGTTACCATAAAAACTATGTTGGAAGATTTGGGTATGGATGACGAAGG
TGACGATGATCCAGTTCCTTTGCCAAATGTCAACGCTGCAATATTGAAGAAAGTTATTCAATGGT
GCACACATCACAAGGACGATCCACCTCCACCTGAAGACGATGAAAATAAGGAAAAGAGAACTGA

Figure 14B (continued)

CGATATTCCAGTATGGGACCAAGAATTCTTGAAGGTTGATCAAGGTACATTGTTCGAATTGATCT
TGGCCGCTAACTATTTGGACATCAAGGGTTTGTTAGATGTAACATGTAAAACCGTTGCTAACATG
ATCAAGGGTAAAACACCAGAAGAAATCAGAAAGACCTTTAATATTAAGAATGATTTCACTGAAGAA
GAAGAAGCACAAGTTAGAAAGGAAAACCAATGGTGCGGTTCTGGT

6. Isopentenyl-Diphosphate Delta-Isomerase (IDI1) – Enzyme Linker – cTPR6 Spacer – ID Linker – ID12 (SEQ ID NO:193)

ATGACTGCTGATAATAACTCTATGCCACATGGTGCCGTATCTTCATACGCTAAGTTGGTTCAAAA
CCAAACACCTGAAGATATCTTGGAAGAATTCCCAGAAATCATCCCTTTGCAACAAAGACCAAACA
CTAGATCCAGTGAAACATCCAACGATGAAAGTGGTGAAACCTGTTTTTCAGGTCATGACGAAGAA
CAAATTAAATTGATGAACGAAAACTGCATCGTATTGGATTGGGATGACAATGCAATAGGTGCCGG
TACTAAGAAAGTTTGTCATTTGATGGAAAACATAGAAAAGGGTTTGTTGCACAGAGCTTTCTCCG
TTTTTATATTCAATGAACAGGGTGAATTGTTATTGCAACAAAGAGCAACAGAAAAGATCACCTTTC
CAGATTTGTGGACTAATACATGTTGCTCTCATCCTTTGTGCATTGATGACGAATTAGGTTTGAAGG
GTAAATTGGATGACAAAATTAAGGGTGCTATAACTGCTGCAGTCAGAAAATTAGATCATGAATTG
GGTATACCAGAAGACGAAACCAAGACTCGTGGTAAATTCCATTTCTTAAACAGAATCCACTATAT
GGCTCCATCTAACGAACCTTGGGGTGAACATGAAATCGATTACATCTTATTTTACAAGATTAATGC
AAAGGAAAACTTGACAGTTAACCCAAACGTTAATGAAGTCAGAGATTTCAAATGGGTTTCTCCTA
ATGATTTGAAGACCATGTTTGCTGACCCATCATATAAGTTTACTCCTTGGTTCAAGATCATCTGTG
AAAACTACTTGTTTAACTGGTGGGAACAATTAGATGACTTGTCTGAAGTTGAAAACGATAGACAA
ATCCATAGAATGTTGAAATTGTCTGGTGGTGGTGGTTCTGGTGGTGGTGGTTCTGGTGGTGGTG
GTAGTGCCGAAGCTTGGTACAATTTGGGTAACGCTTACTACAAGCAGGGTGACTACCAAAAGGC
AATCGAATACTACCAAAAGGCCTTGGAATTGGACCCAAATAACGCAGAAGCCTGGTATAATTTGG
GTAATGCATATTATAAACAGGGTGACTATCAAAAGGCTATTGAATATTACCAAAAGGCATTGGAAT
TGGACCCTAATAACGCTGAAGCATGGTATAATTTGGGTAACGCCTATTATAAGCAGGGTGACTAT
CAAAAAGCCATCGAAGACTACCAAAAGGCTTTGGAATTGGATCCAAACAACTTACAAGCCGAAG
CTTGGAAGAATTTGGGTAACGCTTATTACAAACAGGGTGACTACCAAAAAGCTATTGAATACTAT
CAAAAAGCCTTAGAATTAGACCCTAATAACGCATCTGCCTGGTACAATTTGGGTAATGCCTATTA
CAAGCAGGGTGACTATCAGAAGGCTATTGAATACTACCAAAAAGCATTGGAATTGGATCCAAATA
ACGCTAAGGCATGGTACAGACGTGGTAATGCCTATTACAAGCAGGGTGACTATCAAAAGGCGAT
TGAAGATTATCAAAAGCTTTGGAATTGGATCCTAACAACAGATCTAGATCAGCTGGTGGTGGTG
GTTCTGGTGGTGGTGGTTCTGGTGGTGGTGGTGCTTCTTCATATTACCATCACCATCACCATCAC
TTAGAATCCACAAGTTTGTACAAAAAGGCTGGTTCTGGTTCAAACACCGTTAAGGAATTAAAGAA
CTACATCCAAGAATTGGAAGAAAGAAACGCAGAATTGAAAAATTTGAAGGAACATTTGAAGTTTG
CCAAGGCTGAATTAGAATTCGAATTGGCCGCTCACAAATTTGAAGGTTCCGCTGGTAGTGCAGC
CGGTTCCGGTGAATTCGGTAGTGCAGAAGCTGCAGCCAAAGAAGCTGCAGCCAAGGCTGGTTC
TGCAGGTTCAGCTGCAGGTTCTGGTGAATTTGGTTCCAGTTACTATCACCATCACCATCATCACT
TAGAATCCACTAGTTTGTATAAAAAGGCCGGTTCTGGTTCACAAAAAGTCGCACAATTAAAGAAT
AGAGTAGCCTACAAGTTGAAGGAAAACGCTAAGTTGGAAAACATTGTCGCAAGATTAGAAAACGA
TAATGCCAACTTGGAAAAAGACATCGCTAATTTGGAAAAGGATATTGCAAACTTGGAAAGAGATG
TTGCCAGAGGTTCTGGT

7. Geranyl-Diphosphate Synthase (ERG20$^{WW}$) – Enzyme Linker – cTPR6 Spacer – ID Linker – ID13 (SEQ ID NO:194)

ATGGAAGCTAAGATAGATGAATTGATAAATAACGACCCAGTTTGGTCTTCACAAAACGAATCCTT
GATCAGTAAGCCATACAACCATATCTTGTTAAAACCTGGTAAAAATTTCAGATTAAATTTGATCGT
ACAAATCAACAGAGTTATGAATTTGCCTAAGGATCAATTGGCTATCGTTTCTCAAATAGTCGAATT
GTTGCATAACTCCAGTTTGTTGATCGATGACATCGAAGATAACGCACCATTGAGAAGAGGTCAAA
CTACATCCCACTTAATTTGGGGTGTCCCTAGTACTATTAATACCGCAAACTACATGTACTTCAGAG

Figure 14B (continued)

CCATGCAATTGGTATCACAATTGACCACTAAGGAACCATTGTACCATTGGTTGATCACAATTTTA
ACGAAGAATTGATTAATTTGCACAGAGGTCAAGGTTTGGATATCTATTGGAGAGACTTCTTACCA
GAAATTATACCTACCCAAGAAATGTACTTGAACATGGTAATGAATAAGACTGGTGGTTTGTTTAGA
TTGACCTTGAGATTAATGGAAGCTTTGTCTCCATCTTCACATCACGGTCATTCATTGGTTCCTTTC
ATAAACTTGTTGGGTATCATCTATCAAATCAGAGATGACTACTTGAATTTGAAGGATTTCCAAATG
TCCAGTGAAAAGGGTTTCGCAGAAGACATAACTGAGGGTAAATTGTCATTCCCAATCGTCCATGC
CTTAAACTTCACAAAAACCAAGGGTCAAACCGAACAACACAATGAAATCTTAAGAATTTTGTTATT
GAGAACTTCTGATAAGGACATAAAGTTGAAGTTGATCCAAATCTTGGAATTCGATACCAACTCATT
GGCTTACACTAAGAACTTCATCAACCAATTGGTTAACATGATTAAGAATGATAACGAAATAAGTA
CTTGCCAGATTTGGCCTCCCATAGTGACACTGCTACAAATTTGCACGATGAATTGTTGTACATCA
TCGACCATTTGTCCGAATTGAAATTATCTGGTGGTGGTGGTTCTGGTGGTGGTGGTTCTGGTGG
TGGTGGTAGTGCAGAAGCCTGGTACAACTTGGGTAACGCTTACTACAAGCAGGGTGACTACCAA
AAGGCTATCGAATACTACCAAAAGGCATTGGAATTAGACCCAAATAACGCTGAAGCATGGTACAA
CTTAGGCAACGCATATTATAAACAGGGTGACTATCAAAAGGCCATAGAATACTACCAAAAGGCTT
TGGAATTGGACCCTAATAACGCCGAAGCTTGGTACAACTTGGGTAATGCTTATTACAAGCAGGGT
GACTATCAAAAGCAATTGAAGACTACCAAAAAGCCTTGGAATTAGATCCAAATAACTTGCAAGC
AGAAGCCTGGAAGAACTTAGGCAACGCATACTATAAACAGGGTGACTACCAAAAAGCCATTGAA
TATTATCAAAAAGCTTTGGAATTAGACCCTAATAACGCTTCTGCTTGGTATAACTTAGGCAATGCC
TATTATAAGCAGGGTGACTATCAGAAAGCTATTGAATATTATCAAAAGGCCTTGGAATTGGACCC
AAATAACGCCAAGGCTTGGTACAGACGTGGTAACGCATACTACAAACAGGGTGACTATCAGAAG
GCTATCGAAGATTATCAAAAGCATTAGAATTAGATCCTAATAACAGATCTAGATCAGCTGGTGG
TGGTGGTTCTGGTGGTGGTGGTTCTGGTGGTGGTGGTGCTTCTTTGTGTACTATGAAAAAGGGT
CCATCTGGTTACGGTTTTAATTTGCATTCTGATAAGTCAAAGCCTGGTCAATTCATAAGATCAGTT
GATCCAGACTCCCCTGCAGAAGCCAGTGGTTTGAGAGCTCAAGATAGAATTGTCGAAGTAAATG
GTGTCTGCATGGAAGGTAAACAACACGGTGACGTTGTTTCTGCTATTAGAGCTGGTGGTGACGA
AACTAAGTTATTGGTAGTTGACAGAGAAGGTTCCGCCGGTAGTGCTGCAGGTTCTGGTGAATTT
GGTTCAGCTGAAGCCGCTGCAAAAGAAGCCGCTGCAAAGGCCGGTTCTGCTGGTTCAGCCGCT
GGTTCTGGTGAATTCGGTTCTTCATCCGGTGCTATAATCTATACAGTTGAATTGAAGAGATACGG
TGGTCCATTAGGTATTACTATATCTGGTACAGAAGAACCATTCGATCCTATCATCATCAGTTCTTT
GACTAAGGGTGGTTTAGCTGAAAGAACAGGTGCAATCCATATTGGTGACAGAATATTGGCTATCA
ATTCATCCAGTTTGAAAGGTAAACCATTGTCAGAAGCTATCCACTTATTGCAAATGGCAGGTGAA
ACCGTTACTTTGAAAATCAAAAAGCAAACAGATGCACAACCTGCCTCTTCAGGTTCTGGT

Figure 14C

Codon-optimized CAN Gene Cassette Nucleotide Sequences

1. Olivetol Synthase (OS) – Enzyme Linker – cTPR6 Spacer – ID Linker – ID14 (SEQ ID NO:195)

ATGAATCATTTGAGAGCCGAAGGACCAGCTTCTGTCTTAGCAATAGGTACTGCCAATCCAGAGAA
CATCTTGTTACAAGATGAATTTCCTGACTATTACTTCAGAGTTACCAAATCCGAGCATATGACGCA
GTTGAAGGAAAAGTTTAGAAAGATCTGTGATAAGAGTATGATCAGAAAGAGGAACTGCTTCTTAA
ACGAAGAGCATTTGAAGCAAAATCCTAGATTAGTGGAACACGAGATGCAAACATTGGATGCTAG
GCAGGACATGTTAGTTGTCGAAGTTCCTAAATTGGGTAAAGATGCATGTGCCAAAGCTATTAAGG
AATGGGGTCAACCCAAGTCTAAGATAACTCATTTGATTTTTACTAGTGCTAGCACTACAGATATGC
CTGGTGCAGACTATCACTGTGCCAAACTACTTGGTTTATCGCCCTCTGTGAAGAGAGTTATGATG
TATCAACTAGGTTGCTACGGTGGTGGTACTGTACTTAGAATCGCTAAAGACATTGCAGAAAATAA
CAAGGGTGCCAGGGTCTTGGCTGTATGTTGCGATATTATGGCTTGCTTGTTTAGAGGTCCATCA
GAATCCGATTTGGAGCTGTTGGTTGGTCAAGCTATTTTCGGTGACGGTGCTGCAGCTGTTATTGT
TGGTGCAGAACCTGATGAGTCAGTCGGTGAAAGACCAATCTTTGAATTGGTTTCTACCGGTCAAA

Figure 14C (continued)

CGATTTTACCAAATAGTGAAGGTACAATAGGTGGTCATATCAGAGAAGCTGGTTTGATATTCGAT
TTGCACAAAGACGTTCCTATGCTAATATCTAACAACATCGAAAAGTGTCTGATCGAGGCTTTTAC
CCCCATCGGTATTTCCGATTGGAATAGTATATTCTGGATCACGCATCCAGGTGGTAAAGCAATCC
TGGATAAGGTTGAAGAGAAGCTGCATTTGAAGTCTGATAAGTTTGTCGACAGCAGACATGTATTG
TCGGAACACGGTAACATGTCTTCATCCACAGTGCTGTTCGTTATGGATGAACTTAGAAAGAGATC
TTTGGAAGAGGGTAAAAGCACCACGGGTGACGGTTTTGAATGGGGTGTTCTTTTTGGATTCGGC
CCCGGTTTGACCGTCGAAAGAGTAGTTGTTAGATCTGTACCAATTAAATACAAGTTGTCTGGTGG
TGGTGGTTCTGGTGGTGGTGGTTCTGGTGGTGGTGGTAGTGCAGAAGCCTGGTACAATTTGGGT
AACGCTTACTACAAGCAGGGTGACTACCAGAAGGCTATCGAGTATTACCAAAAAGCACTTGAACT
GGATCCAAATAACGCTGAGGCATGGTATAATTTGGGCAACGCATATTACAAACAGGGTGACTATC
AAAAGGCCATAGAATACTACCAAAAGGCTTTGGAGCTGGATCCTAATAACGCCGAAGCTTGGTA
CAATTTGGGAAATGCCTATTATAAGCAGGGTGACTATCAGAAGGCAATAGAGGACTACCAAAAAG
CCCTAGAACTTGATCCAAATAATTTGCAGGCAGAAGCCTGGAAGAATTTGGGTAATGCTTACTAT
AAACAGGGTGACTATCAGAAAGCTATTGAATACTACCAAAAAGCACTGGAATTGGATCCTAATAA
CGCTTCTGCTTGGTACAATTTGGGCAACGCTTACTACAAACAGGGTGACTACCAAAAGCTATCG
AATATTATCAAAAGGCTCTGGAACTAGATCCAAATAACGCCAAGGCTTGGTATAGAAGGGGAAAT
GCTTATTATAAACAGGGTGACTACCAGAAAGCAATTGAAGACTACCAAAAAGCCCTTGAACTGGA
TCCTAATAACAGATCTAGAAGCGCTGGTGGTGGTGGTTCTGGTGGTGGTGGTTCTGGTGGTGGT
GGTGCTTCTGGTAACAACTTAGAAACATACGAGTGGTACAATAAGTCTATTTCTAGAGATAAGGC
CGAAAAGTTACTACTTGACACCGGTAAAGAAGGTGCTTTTATGGTTAGAGATTCTAGAACTCCAG
GTACTTATACAGTCTCTGTATTCACAAAGGCTATCATCTCAGAAAACCCATGTATCAAGCATTACC
ACATCAAGGAAACCAACGACTCTCCTAAAAGATATTACGTGGCAGAAAAGTACGTTTTTGATTCA
ATCCCACTGTTGATTCAATATCATCAGTACAATGGTGGTGGTTTGGTGACTAGATTGAGGTATCC
TGTTTGCGGTGGTAGCGCAGGTTCGGCTGCAGGATCAGGCGAATTTGGTTCCGCCGAGGCCGC
TGCAAAAGAAGCCGCTGCAAAGGCTGGATCTGCAGGCTCAGCCGCTGGTTCTGGAGAATTTGG
TTCTGGTTCTCATCCCTGGTTTTTCGGTAAAATTCCAAGAGCAAAGGCCGAAGAAATGTTGTCTA
AACAAAGACACGACGGTGCATTTTTGATAAGGGAAAGTGAGAGCGCACCTGGTGACTTTTCGTT
GTCTGTTAAATTCGGTAATGATGTCCAACATTTCAAGGTATTGAGAGATGGTGCTGGTAAATACTT
TTTGTGGGTCGTAAAGTTCAATTCCTTGAACGAATTAGTGGATTACCATAGATCAACTTCCGTTAG
TAGGAACCAACAGATTTTCTTGAGAGATATCGAACAAGTTCCACAACAGCCTACAGGTTCTGGA

2. Olivetolic Acid Cyclase (OAC) – Enzyme Linker – cTPR6 Spacer – ID Linker – ID15 (SEQ ID NO:196)

ATGGCTGTAAAGCATTTGATCGTGTTGAAATTCAAGGATGAAATCACAGAGGCACAAAAGGAAGA
GTTTTTCAAGACCTACGTTAATTTGGTCAACATAATCCCAGCTATGAAAGATGTATACTGGGGTAA
AGACGTGACCCAAAAGAATAAGGAAGAGGGTTATACCCATATAGTAGAAGTGACGTTCGAATCA
GTTGAAACTATCCAAGATTACATCATACACCCTGCTCATGTTGGCTTTGGTGACGTCTACAGATC
CTTCTGGGAAAAGTTGCTGATCTTCGATTACACTCCAAGAAAGAAATTGTCTGGTGGTGGTGGTT
CTGGTGGTGGTGGTTCTGGTGGTGGTGGTAGTGCAGAAGCCTGGTATAATTTGGGAAACGCTTA
TTACAAACAGGGTGACTACCAAAAGGCCATCGAGTATTACCAAAAAGCTCTTGAACTGGACCCAA
ATAACGCTGAGGCATGGTATAATTTGGGTAACGCATACTATAAGCAAGGTGACTACCAAAAGGCA
ATTGAATATTACCAAAAGGCCTTGGAGTTAGACCCTAATAACGCCGAAGCTTGGTACAATTTGGG
TAATGCCTACTATAAACAGGGTGACTATCAAAAGGCTATAGAGGACTACCAGAAAGCACTAGAAC
TTGATCCCAATAACTTGCAAGCAGAAGCCTGGAAGAATTTGGGTAATGCCTATTATAAGCAAGGT
GACTATCAAAAGCTATTGAATACTACCAAAAAGCTCTGGAATTGGACCCTAATAACGCTTCTGC
TTGGTATAATTTGGGTAATGCATACTACAAGCAAGGTGACTACCAGAAGGCAATAGAGTATTACC
AAAAAGCCTTAGAACTAGACCCAAATAACGCCAAGGCTTGGTACAGAAGGGGTAATGCCTACTA
CAAGCAGGGTGACTACCAAAAGCTATTGAGGACTACCAAAAGCACTTGAACTGGATCCTAATA
ACAGATCTAGATCAGCTGGTGGTGGTGGTTCTGGTGGTGGTGGTTCTGGTGGTGGTGGTGCTTC
CGGTCAAGATAGAAGTGAAGCCACATTGATTAAAAGATTCAAAGGAGAAGGTGTTAGATACAAG

Figure 14C (continued)

GCTAAGCTGATCGGTATCGATGAAGTTTCTGCTGCTAGAGGTGACAAATTGTGTCAAGACTCTAT
GATGAAGCTGAAGGGCGTTGTCGCAGGTGCCAGATCTAAGGGTGAACATAAGCAAAAGATATTT
TTGACGATCTCATTCGGTGGTATTAAAATCTTCGATGAAAAGACTGGTGCTTTACAACATCACCAT
GCAGTACACGAAATCTCTTACATCGCTAAGGATATCACAGACCATAGAGCATTCGGTTACGTTTG
CGGTAAAGAAGGCAATCATAGATTTGTCGCTATTAAAACCGCCCAAGCCGCTGAACCAGTCATCT
TGGATTTGAGAGACTTATTCCAGCTAATCTATGAACTAAAGCAAAGAGAAGAATTGGAAAAGAAA
GCTGGTAGCGCAGGATCGGCAGCCGGTAGCGGAGAATTTGGTTCTGCTGAGGCTGCAGCCAAA
GAAGCTGCAGCCAAGGCCGGCTCTGCTGGTTCAGCTGCAGGCTCTGGTGAATTTGGTTCTGGTT
CTCATATGGGTTCTCAATTTTGGGTAACTTCTCAAAAGACTGAAGCTTCCGAGAGATGTGGTTTG
CAAGGCTCCTATATTTTAAGGGTGGAAGCCGAGAAGCTTACCCTACTTACGCTGGGTGCACAGA
GTCAAATATTGGAACCCCTGTTGTTCTGGCCATATACTTTATTGAGAAGATACGGTAGAGATAAA
GTTATGTTCAGTTTCGAAGCTGGTAGAAGATGCCCAAGCGGTCCTGGAACTTTTACATTCCAGAC
ATCACAAGGCAATGATATCTTTCAGGCAGTTGAAGCCGCTATTCAACAGCAAAAAGCCCAGGGT
AAAGTCGGACAGGCTCAAGACATTCTAAGATTGGAACACCATCACCATCATCATGGTTCTGGT

3. CBGA Synthase (CBGAS) – Enzyme Linker – cTPR6 Spacer – ID Linker – ID16 (SEQ ID NO:197)

ATGGGTTTGTCTTCAGTTTGTACATTCTCTTTCCAAACGAACTACCATACTTTGCTGAACCCTCAC
AACAACAATCCCAAAACTTCTTTGCTTTGCTACAGACATCCAAAAACCCCTATTAAGTATAGCTAC
AACAATTTCCCATCGAAACATTGTAGTACTAAGAGCTTCCATTTGCAAAATAAGTGCTCCGAATCT
TTGTCTATCGCTAAGAACTCAATTAGAGCTGCAACTACAAATCAGACGGAACCACCTGAGTCGGA
TAATCACTCTGTAGCCACCAAAATTTTGAACTTTGGTAAAGCTTGTTGGAAGCTGCAAAGACCAT
ACACAATAATAGCCTTCACCTCCTGTGCTTGCGGTTTGTTTGGTAAAGAACTGTTGCATAACACA
AATTTGATTTCGTGGTCTTTGATGTTCAAGGCATTTTCTTTTTGGTTGCAATCCTTTGCATCGCCT
CTTTTACCACGACTATTAATCAAATCTATGATTTGCACATCGACAGAATTAATAAGCCCGATTTGC
CACTAGCTTCAGGTGAAATCTCCGTTAATACTGCATGGATTATGTCAATCATTGTCGCCTTGTTCG
GTTTAATCATCACAATTAAAATGAAAGGTGGTCCATTGTACATCTTCGGCTACTGTTTCGGTATAT
TCGGTGGTATAGTATATTCCGTTCCACCTTTTAGATGGAAACAAAACCCCAGTACCGCTTTCTTAC
TAAATTTCTTGGCACATATCATCACAAACTTCACCTTCTACTACGCTTCTAGAGCTGCTTTGGGTT
TGCCATTCGAATTAAGACCATCTTTTACATTTTTGCTGGCTTTTATGAAATCGATGGGTTCTGCAT
TGGCCTTGATTAAAGATGCATCTGACGTTGAAGGTGACACAAAATTCGGCATCAGTACCTTGGCT
AGCAAGTACGGTTCTAGAAATTTGACTTTGTTTTGTTCAGGTATCGTATTGTTATCCTACGTGGCA
GCCATTTTAGCCGGTATCATTTGGCCACAAGCTTTTAACAGTAATGTCATGCTACTTAGCCACGC
AATATTGGCCTTCTGGCTGATCTTGCAGACGAGAGATTTTGCTTTAACTAATTATGACCCTGAGG
CAGGTAGAAGATTCTACGAATTCATGTGGAAGCTGTACTACGCTGAATATTTGGTTTACGTCTTTA
TTAAGTTGTCTGGTGGTGGTGGTTCTGGTGGTGGTGGTTCTGGTGGTGGTGGTAGTGCTGAAGC
ATGGTACAACTTAGGCAACGCATACTACAAGCAGGGTGACTACCAGAAGGCAATTGAGTATTAC
CAAAAAGCCTTAGAACTAGACCCAAACAATGCCGAGGCTTGGTATAACTTGGGCAATGCTTATTA
CAAACAGGGTGACTATCAAAGGCTATAGAATATTACCAAAAGGCACTTGAGCTGGACCCTAACA
ATGCAGAAGCCTGGTATAACTTAGGCAATGCTTATTACAAGCAGGGTGACTATCAGAAGGCCAT
CGAGGACTACCAAAAGGCTTTGGAACTGGATCCAAACAATTTGCAGGCTGAAGCATGGAAGAAT
TTGGGTAACGCTTACTATAAACAGGGTGACTATCAGAAGCAATAGAATACTACCAAAAAGCCCT
AGAACTTGACCCTAACAATGCCTCTGCTTGGTACAACTTGGGTAATGCTTACTATAAGCAGGGTG
ACTACCAAAAAGCTATCGAATATTACCAAAAAGCACTGGAATTGGACCCAAACAATGCAAAGGCC
TGGTATAGAAGAGGTAACGCCTACTACAAACAGGGTGACTACCAAAAGGCTATTGAAGATTACCA
AAAGGCTCTGGAACTAGATCCTAACAACAGATCTAGATCCGCTGGTGGTGGTGGTTCTGGTGGT
GGTGGTTCTGGTGGTGGTGGTGCTTCTGCAGAATACGTTAGAGCTCTGTTCGATTTCAACGGTA
ACGATGAAGAGGACTTGCCTTTTAAGAAAGGTGACATTTTGAGAATCAGGGACAAACCAGAAGA
GCAATGGTGGAATGCTGAAGATTCTGAGGGTAAAAGAGGAATGATTCCTGTTCCCTATGTCGAA
AAGTACGGCTCAGCAGGTTCCGCTGCAGGATCTGGCGAATTCGGTTCAGCCGAGGCCGCTGCA

Figure 14C (continued)

```
AAAGAAGCCGCTGCAAAGGCTGGAAGTGCAGGCAGCGCCGCTGGTTCCGGAGAATTTGGTAGT
TTGATTAAACATATGAGAGCCGAAGCTTTATTCGATTTTACTGGTAACTCCAAACTTGAACTGAAT
TTCAAGGCAGGTGACGTTATTTTCTTGTTGAGTAGAATTAATAAGGACTGGTTGGAAGGTACTGT
TAGAGGTGCTACTGGAATATTCCCACTTTCTTTTGTGAAAATCCTGAAGGGCTCAGGT
```

4. CBDA Synthase (CBDAS) (SEQ ID NO:198)

```
ATGAAATGTAGCACTTTTTCTTTCTGGTTCGTTTGCAAGATCATTTTCTTTTTCTTTTCTTTTAATAT
CCAAACTTCGATCGCAAATCCAAGAGAAAACTTCTTAAAGTGTTTCTCACAATACATTCCTAATAA
CGCCACGAATTTGAAGCTGGTATACACTCAGAACAACCCACTGTACATGAGCGTGCTAAACTCG
ACAATCCATAATTTGAGATTCACTTCCGATACTACACCCAAACCATTAGTAATCGTGACACCTTCT
CATGTTTCACACATTCAAGGAACCATACTATGCTCTAAGAAAGTCGGTTGCAGATTAGAACAAG
GTCTGGTGGTCATGATAGTGAAGGCATGTCCTACATCAGTCAAGTCCATTCGTTATCGTCGATT
TGAGAAACATGAGGTCTATCAAAATAGACGTTCACTCACAGACGGCTTGGGTCGAGGCAGGTGC
CACTTTGGGAGAAGTTTACTACTGGGTCAACGAAAGAATGAAAATTTGTCTCTTGCTGCAGGTT
ACTGTCCAACTGTCTGCGCTGGTGGTCATTTTGGTGGTGGTGGTTATGGACCTCTTATGAGAAAC
TACGGTTTGGCCGCTGATAATATCATTGACGCACATTTGGTAAATGTGCACGGTAAAGTTCTAGA
TAGAAAGTCAATGGGTGAAGATTTGTTTTGGGCATTGAGAGGTGGTGGTGCTGAATCCTTTGGTA
TAATCGTAGCTTGGAAAATTAGATTGGTTGCAGTCCCAAAGTCTACAATGTTCTCAGTTAAGAAAA
TTATGGAAATCCATGAGCTGGTAAAGTTGGTGAATAAGTGGCAAAACATCGCTTACAAGTACGAT
AAGGACTTGCTGCTAATGACCCATTTCATCACGAGAAACATCACTGATAACCAGGGTAAAAATAA
GACAGCAATACACACCTACTTCTCTTCAGTTTTCTTGGGTGGTGTTGATTCCTTAGTGGATTTGAT
GAATAAGAGTTTCCCTGAACTGGGTATTAAGAAAACTGATTGTAGACAATTGAGCTGGATCGACA
CAATCATATTCTATAGTGGTGTTGTCAACTACGATACTGACAACTTCAACAAAGAAATCCTTCTGG
ATAGAAGTGCCGGACAAAATGGCGCTTTCAAAATTAAGTTGGACTACGTTAAAAAGCCTATACCC
GAGTCAGTATTTGTGCAGATCCTTGAAAAACTGTATGAAGAGGATATTGGTGCTGGAATGTACGC
ATTATATCCATACGGTGGTATAATGGATGAAATCTCCGAGAGTGCCATACCATTCCCTCATAGAG
CTGGTATCTTGTACGAACTGTGGTACATATGTTCTTGGGAAAAACAAGAGGATAACGAAAGCAC
TTAAACTGGATCAGGAACATCTATAACTTCATGACTCCTTACGTTTCTAAAAACCCCAGATTGGCT
TATTTGAATTACAGAGATTTGGACATAGGTATCAACGATCCTAAAAATCCAAACAACTACACACAA
GCAAGAATTTGGGGTGAAAAGTACTTCGGTAAAAATTTCGATAGATTGGTTAAAGTCAAGACCTT
AGTTGACCCCAACAACTTTTTCAGAAACGAACAATCTATTCCACCTTTGCCTAGACATAGGCACG
GCTCTGGT
```

5. CBCA Synthase (CBCAS) (SEQ ID NO:199)

```
ATGAACTGTAGCACTTTTTCTTTTGGTTCGTTTGCAAGATAATATTTTTCTTTTTGTCCTTTAATAT
CCAAATCAGTATCGCCAACCCACAGGAAAACTTTTTAAAGTGTTTCTCTGAGTACATCCCCAACA
ACCCAGCTAACCCTAAGTTTATATATACACAACATGATCAGCTGTACATGAGCGTATTGAACTCG
ACCATTCAAAATTTGAGATTCACTTCTGACACTACACCTAAGCCCTTGGTCATAGTAACTCCTTCT
AATGTCTCACATATACAAGCTTCTATCTTGTGCTCTAAGAAAGTTGGTTTGCAGATTAGAACAAGG
TCTGGTGGTCACGATGCAGAAGGTTTATCCTATATTAGTCAAGTCCCATTTGCCATAGTAGATTT
GAGAAATATGCATACTGTGAAAGTTGACATACACTCACAGACTGCTTGGGTGGAAGCAGGTGCC
ACATTGGGAGAGGTTTACTACTGGATCAACGAGATGAACGAAAACTTTAGTTTCCCAGGTGGTTA
CTGTCCCACAGTCGGTGTTGGTGGTCATTTTCTGGTGGTGGTTATGGAGCTTTAATGAGAAACT
ACGGTTTGGCTGCAGATAATATCATTGACGCACATTTGGTGAACGTTGATGGTAAAGTTCTTGAC
AGAAATCAATGGGTGAAGATTTGTTTTGGGCTATCAGAGGTGGTGGTGGTGAAAATTTCGGTAT
AATCGCCGCTTGCAAAATTAAGTTGGTTGTCGTACCTAGCAAAGCTACTATTTTCTGTCAAAAA
GAACATGGAAATCCATGGTTTAGTAAAGTTGTTTAATAAGTGGCAAAACATCGCATACAAGTACG
ATAAGGATTTGATGCTTACCACGCATTTCAGAACTAGGAACATCACAGATAACCATGGTAAAAAT
AAGACTACAGTTCACGGATACTTCTCTTCAATTTTCTTGGGTGGTGTTGATTCTCTTGTTGATTTG
```

Figure 14C (continued)

ATGAATAAGTCATTCCCAGAACTGGGTATTAAAAAGACAGATTGTAAGGAACTGAGCTGGATCGA
CACCACGATTTTCTATAGTGGTGTGGTTAATTACAACACCGCCAACTTCAAAAAGGAAATCTTGC
TGGATAGATCCGCTGGTAAAAAGACCGCTTTTTCTATTAAACTTGACTACGTTAAGAAACTGATCC
CTGAAACTGCAATGGTTAAGATATTGGAGAAGCTGTACGAAGAGGAAGTCGGCGTAGGCATGTA
CGTTTTGTATCCATACGGTGGTATAATGGATGAGATCTCCGAAAGTGCCATACCATTTCCTCATA
GAGCTGGTATCATGTATGAATTATGGTACACCGCTACGTGGGAGAAGCAAGAAGATAACGAGAA
ACACATAAACTGGGTCAGATCTGTATACAACTTCACTACACCTTACGTTTCTCAGAACCCAAGATT
GGCATATTTGAACTACAGAGATTTGGACTTGGGTAAAACCAACCCCGAATCTCCAAATAACTATA
CGCAAGCAAGAATTTGGGGTGAAAAGTACTTCGGTAAAAATTTCAACAGATTGGTGAAGGTTAAG
ACAAAAGCCGATCCAAACAACTTCTTTAGAAACGAACAATCTATTCCACCATTGCCACCAAGACA
TCATGGTTCCGGC

6. <u>Acetyl-CoA Carboxylase (ACC) – Enzyme Linker – cTPR6 Spacer – ID Linker – ID17 (SEQ ID NO:200)</u>

ATGTCAGAAGAGTCCTTATTTGAATCTTCACCACAAAAGATGGAGTACGAAATCACTAACTACTCT
GAGAGACATACAGAATTGCCTGGACACTTCATCGGTTTGAACACAGTTGACAAGCTGGAAGAGT
CTCCATTGAGAGATTTCGTCAAGTCCCATGGTGGTCACACCGTAATTAGTAAGATCTTGATAGCT
AACAACGGTATCGCTGCAGTCAAGGAAATTAGATCTGTTAGAAAGTGGGCATATGAAACCTTTGG
TGACGATAGAACGGTCCAATTCGTAGCTATGGCAACTCCTGAAGACTTGGAGGCCAATGCTGAA
TATATCAGAATGGCCGATCAATACATTGAAGTTCCAGGTGGTACAAATAACAATAACTACGCTAAT
GTCGACTTAATAGTAGATATCGCTGAAAGAGCAGACGTGGATGCCGTTTGGGCTGGTTGGGGAC
ATGCTTCCGAAAACCCTTTGTTACCCGAAAAATTGTCTCAGAGTAAGAGAAAAGTTATTTTATTG
GTCCACCTGGAAATGCAATGAGATCATTAGGTGACAAGATATCCAGTACTATCGTGGCACAATCA
GCCAAAGTTCCATGTATTCCTTGGTCCGGCACCGGTGTTGACACGGTGCATGTTGATGAAAAGA
CTGGTTTGGTTTCTGTAGATGACGATATCTATCAGAAGGGATGTTGCACTTCACCTGAAGATGGT
TTGCAAAAGGCTAAGAGAATCGGTTTCCCAGTTATGATCAAGGCATCAGAAGGTGGTGGTGGTA
AAGGTATCAGGCAGGTCGAAAGAGAAGAGGATTTCATCGCTCTGTACCATCAAGCCGCTAATGA
ATACCCGGTTCTCCAATTTTCATAATGAAACTAGCTGGAAGGGCAAGACATTTGGAAGTTCAGC
TACTTGCTGACCAATACGGCACTAATATTTCCTTGTTCGGTAGAGATTGCAGTGTTCAAAGAAGA
CATCAAAAGATTATCGAAGAGGCACCAGTCACTATAGCAAAAGCCGAAACATTTCACGAGATGGA
AAAGGCAGCTGTTAGATTGGGTAAATTGGTCGGATATGTAAGTGCTGGAACAGTCGAATATTTGT
ACAGCCATGACGATGGTAAATTCTACTTTTTGGAACTTAACCCAAGATTACAAGTTGAGCACCCT
ACTACAGAAATGGTTTCTGGTGTTAATTTGCCAGCTGCACAACTGCAGATTGCTATGGGTATCCC
TATGCATAGAATCAGTGATATCAGGACTCTGTACGGTATGAATCCACACAGCGCTTCGGAGATTG
ACTTCGAATTCAAAACTCAGGATGCAACTAAGAAACAAAGAAGACCAATCCCAAAGGGTCATTGT
ACCGCTTGCAGAATTACGTCCGAAGACCCCAATGATGGTTTTAAACCATCTGGTGGTACTTTGCA
CGAACTAAACTTTAGAAGCTCGTCTAATGTCTGGGGTTATTTCTCAGTAGGCAACAACGGTAACA
TCCATTCTTTTTCAGATTCCCAGTTCGGTCACATCTTCGCATTTGGAGAAAATAGGCAAGCCTCTA
GAAAGCATATGGTTGTCGCTCTTAAAGAACTGTCAATCAGAGGTGACTTCAGAACCACGGTTGAA
TACTTAATTAAACTGTTGGAAACTGAAGACTTCGAAGATAATACGATTACTACAGGTTGGTTGGAC
GATTTGATAACCCATAAGATGACGGCAGAAAAACCTGATCCCACCTTGGCCGTTATCTGTGGTG
CCGCTACGAAGGCCTTTTTAGCTTCTGAAGAGGCTAGACATAAGTACATAGAAAGCCTGCAAAA
GGGTCAGGTACTATCGAAAGACTTACTACAAACAATGTTTCCTGTGGATTTCATCCACGAAGGTA
AAAGATACAAGTTTACTGTTGCTAAGTCTGGCAACGATAGGTACACGTTGTTCATTAATGGTAGC
AAGTGCGACATCATTCTAAGACAACTTTCAGATGGTGGTTTGCTGATCGCAATTGGTGGTAAATC
ACATACTATCTATTGGAAGGAAGAGGTCGCAGCCACAAGATTGAGTGTAGACAGCATGACCACG
TTGTTAGAGGTTGAAAACGATCCAACTCAATTAAGAACACCATCTCCTGGTAAACTTGTGAAATTT
CTGGTTGAAAATGGCGAGCATATAATCAAGGGTCAACCCTACGCTGAGATTGAAGTTATGAAAAT
GCAGATGCCATTGGTTTCTCAAGAAAACGGTATAGTTCAACTACTTAAACAGCCTGGATCAACCA

Figure 14C (continued)

```
TAGTAGCTGGTGACATCATGGCAATTATGACGTTAGACGATCCATCCAAGGTGAAACATGCTCTT
CCTTTTGAGGGTATGCTGCCCGATTTCGGTTCTCCAGTTATTGAAGGCACTAAACCAGCATACAA
GTTTAAATCGTTGGTTTCTACACTGGAAAACATCCTAAAGGGTTACGATAACCAAGTTATTATGAA
TGCTTCTTTGCAACAGTTGATAGAAGTCTTGAGAAATCCTAAGTTACCCTATTCAGAATGGAAATT
GCATATTAGCGCTCTTCACTCGAGATTGCCTGCAAAATTGGATGAACAAATGGAAGAGCTAGTCG
CTAGATCTTTGAGAAGAGGTGCTGTATTTCCAGCAAGGCAATTGAGTAAGCTAATTGACATGGCA
GTTAAAAACCCAGAATACAACCCTGATAAACTGTTGGGTGCCGTAGTGGAACCATTGGCAGATAT
TGCCCATAAGTACTCTAATGGTTTAGAAGCTCATGAGCACTCAATCTTCGTGCATTTCTTGGAAG
AGTACTACGAGGTTGAAAAATTGTTCAACGGTCCTAACGTCAGAGAAGAGAACATCATCCTGAAG
TTGAGAGATGAAAACCCAAAGGACTTGGATAAAGTCGCTCTTACTGTACTGAGTCATAGCAAGGT
TTCTGCCAAAAATAACTTAATCCTAGCTATCCTGAAGCACTACCAACCTTTGTGTAAGCTGTCATC
CAAAGTTTCTGCAATATTTTCAACTCCATTGCAACATATCGTAGAGCTTGAATCTAAGGCTACCGC
AAAAGTGGCTTTGCAGGCAAGAGAAATTTTGATCCAAGGTGCTTTGCCATCAGTTAAAGAAAGAA
CAGAGCAAATAGAACACATCCTGAAGAGTAGCGTTGTCAAAGTCGCATACGGTTCGTCTAATCCT
AAGAGATCTGAACCCGATTTGAATATACTTAAGGATTTGATCGATTCAAATTACGTAGTGTTTGAC
GTTTTACTACAGTTCTTAACTCATCAAGATCCTGTTGTCACAGCTGCAGCCGCTCAAGTCTATATA
AGAAGGGCCTATAGAGCTTACACTATCGGTGACATTAGGGTACACGAAGGCGTGACAGTTCCAA
TCGTGGAATGGAAATTTCAATTGCCCTCCGCAGCCTTTAGTACCTTCCCAACGGTAAAGTCAAAA
ATGGGTATGAACAGAGCTGTTTCTGTTTCTGATTTGAGCTATGTGGCTAATTCGCAATCATCCCC
TTTAAGAGAAGGTATTCTAATGGCTGTGGACCATTTGGACGATGTTGATGAAATTTTGTCTCAATC
TTTGGAAGTTATTCCAAGACACCAAAGTAGCTCGAATGGTCCCGCTCCAGATAGGTCTGGATCTT
CAGCAAGTTTAAGCAACGTAGCCAATGTGTGTGTTGCTTCCACTGAGGGTTTTGAAAGTGAAGA
GGAAATCTTGGTTAGATTGAGAGAAATTTTGGATTTGAACAAACAAGAATTGATTAATGCTTCCAT
CAGAAGGATCACATTCATGTTCGGTTTTAAAGATGGTAGTTACCCTAAGTACTACACCTTTAATGG
TCCCAACTACAACGAGAACGAAACTATCAGACATATCGAACCTGCCTTAGCTTTCCAATTGGAAC
TGGGTAGATTGTCAAACTTCAACATCAAGCCAATTTTCACTGATAACAGAAACATCCATGTGTAC
GAAGCTGTTTCAAAGACATCCCCATTAGATAAGAGATTTTTCACCAGAGGCATCATTAGGACGGG
TCACATTAGAGATGATATTAGCATACAAGAGTACTTGACTTCGGAAGCTAACAGATTAATGTCTGA
CATCCTAGATAATTTGGAAGTTACCGACACGTCGAACTCTGATTTGAACCATATCTTTATTAACTT
CATCGCAGTGTTCGACATATCTCCTGAGGATGTTGAAGCTGCATTTGGTGGTTTCTTGGAAAGAT
TCGGTAAAAGATTGCTGAGATTGAGAGTCTCCAGTGCTGAAATCAGAATCATCATTAAGGATCCA
CAAACTGGTGCCCCTGTACCCCTGAGAGCTTTGATCAATAATGTTTCTGGTTACGTAATTAAAAC
CGAGATGTACACGGAAGTCAAGAATGCTAAGGGTGAATGGGTATTCAAGAGCTTGGGTAAACCC
GGCTCGATGCACTTAAGACCAATTGCAACACCATATCCTGTCAAAGAATGGTTGCAACCTAAGAG
ATACAAAGCCCACTTAATGGGTACTACATACGTTTACGATTTCCCAGAATTGTTCAGACAGGCTT
CTTCTTCTCAATGGAAGAATTTTTCCGCCGACGTTAAGCTGACTGACGATTTCTTTATCAGTAACG
AACTAATCGAGGATGAAAATGGTGAACTTACAGAGGTTGAAAGAGAGCCAGGAGCAAATGCCAT
TGGCATGGTCGCTTTTAAGATCACTGTAAAGACACCAGAATATCCTAGGGGTAGACAATTCGTAG
TGGTTGCAAACGACATCACCTTTAAAATTGGTTCTTTCGGACCTCAAGAAGATGAGTTTTTCAATA
AGGTTACTGAATACGCTAGGAAAAGAGGTATACCAAGAATCTACTTGGCCGCTAATTCTGGAGCA
AGGATTGGCATGGCCGAGGAAATAGTGCCTTTATTTCAGGTTGCATGGAACGACGCAGCCAACC
CAGATAAGGGATTCCAATATTTGTATTTGACTTCTGAGGGTATGGAAACATTGAAAAGTTCGATA
AGGAAAACTCAGTGCTGACCGAGAGAACTGTTATTAATGGAGAGGAAAGGTTCGTAATCAAAACT
ATAATCGGTTCTGAAGATGGTTTGGGCGTGGAGTGTCTGAGAGGTAGCGGTTTGATTGCTGGTG
CAACTTCTAGAGCTTACCATGATATTTTTACTATCACACTGGTCACTTGCAGATCTGTAGGCATAG
GTGCTTATTTGGTTAGATTGGGTCAAAGGGCCATCCAGGTCGAAGGCCAACCTATTATATTGACT
GGTGCCCCGCTATAAACAAAATGCTGGGTAGAGAAGTTTATACCTCCAATTTGCAGTTGGGTG
GTACGCAAATCATGTACAATAACGGTGTTTCTCATTTGACAGCTGTAGACGATTTGGCTGGTGTG
GAAAAGATTGTTGAATGGATGTCATATGTGCCAGCTAAAAGAAACATGCCCGTTCCAATATTGGA
```

Figure 14C (continued)

```
AACTAAGGACACATGGGATAGACCAGTAGATTTTACCCCTACGAATGACGAAACCTATGATGTGA
GATGGATGATTGAGGGTAGGGAAACTGAGTCTGGTTTTGAATACGGTTTGTTCGATAAGGGTTCT
TTCTTTGAAACATTATCAGGCTGGGCCAAGGGTGTCGTAGTGGGAAGAGCTAGATTGGGTGGTA
TTCCTCTAGGTGTTATTGGTGTAGAAACTAGAACAGTTGAAAATTTGATCCCCGCAGATCCAGCC
AACCCTAATTCTGCTGAAACTTTAATTCAGGAACCTGGTCAAGTTTGGCATCCCAACTCAGCTTTT
AAAACCGCACAGGCCATTAATGATTTCAACAACGGTGAACAATTGCCAATGATGATACTGGCTAA
CTGGAGAGGTTTTTCTGGTGGTCAAAGGGATATGTTCAACGAAGTTTTGAAGTACGGTAGTTTTA
TCGTCGACGCACTGGTAGATTACAAGCAACCTATCATAATATACATTCCACCAACTGGTGAATTA
AGAGGTGGTTCTTGGGTTGTCGTAGACCCAACCATTAACGCAGATCAGATGGAAATGTACGCCG
ATGTGAATGCTAGAGCAGGTGTTTTGGAACCACAAGGAATGGTTGGTATTAAGTTTAGAAGAGAA
AAATTGCTGGATACTATGAACAGATTAGACGATAAGTACAGGGAATTGAGATCTCAACTGAGCAA
TAAGTCTTTGGCTCCAGAAGTTCATCAACAGATCTCTAAGCAACTGGCTGATAGGGAAAGAGAAT
TGTTGCCAATATACGGTCAGATCTCATTGCAATTTGCCGACTTACACGATAGGTCATCCAGAATG
GTGGCTAAGGGTGTTATTTCAAAAGAATTAGAGTGGACAGAAGCTAGAAGATTTTTCTTTTGGAG
ATTGAGAAGAAGATTGAACGAGGAATATTTGATTAAAAGATTGTCACATCAAGTTGGCGAGGCTT
CTAGATTGGAAAAGATCGCAAGGATTAGATCTTGGTATCCAGCATCAGTCGATCACGAAGACGAT
AGACAAGTAGCCACTTGGATTGAGGAAAATTACAAGACACTGGACGATAAGTTGAAGGGTTTAAA
GCTAGAATCCTTTGCCCAAGACTTGGCTAAAAAGATTAGAAGTGACCATGATAATGCTATCGATG
GTTTGAGTGAAGTTATTAAAATGCTTAGCACTGACGATAAGGAAAAACTGTTGAAGACATTGAAG
AAACTGTCTGGTGGTGGTGGTTCTGGTGGTGGTGGTTCTGGTGGTGGTAGTGCCGAAGCT
TGGTATAACTTGGGAAATGCTTATTACAAGCAGGGTGACTACCAAAAGGCCATAGAATACTACCA
AAAGGCTCTTGAGCTGGATCCTAATAACGCAGAAGCCTGGTATAACTTAGGCAATGCATACTATA
AACAAGGTGACTACCAAAAGGCAATAGAGTACTACCAAAAGGCCTTGGAATTAGATCCAAATAAC
GCTGAGGCATGGTATAACTTGGGCAACGCCTACTATAAACAGGGTGACTATCAAAAGGCTATAG
AAGATTACCAGAAGGCACTAGAGCTTGATCCTAATAACTTGCAAGCCGAAGCTTGGAAGAACTTA
GGAAATGCATACTATAAGCAAGGTGACTATCAAAAGCTATTGAATATTACCAAAAGGCTCTGGA
GTTGGATCCAAATAACGCATCTGCTTGGTACAACTTAGGCAACGCCTACTATAAGCAGGGTGACT
ATCAAAAGCAATTGAATATTATCAAAAGGCCTTAGAGCTAGATCCTAATAACGCTAAAGCATGGT
ATAGGAGAGGCAATGCATACTACAAACAGGGTGACTACCAAAAAGCTATAGAAGATTACCAAAAG
GCACTTGAACTGGATCCAAATAACAGATCTAGATCCGCTGGTGGTGGTGGTTCTGGTGGTGGTG
GTTCTGGTGGTGGTGGTGCTTCTGGTTCTCATATGAGATTGGGAGCCCAATCTATTCAGCCAAC
CGCTAACTTAGATAGAACGGACGATTTGGTCTATTTGAATGTAATGGAATTGGTTAGAGCTGTTTT
GGAGTTGAAAAATGAACTAGCACAATTGCCACCAGAAGGTTACGTGGTTGTCGTAAAGAATGTTG
GTTTGACTCTTAGAAAGTTGATAGGCTCGGTCGACGATTTGCTACCATCTTTGCCATCTTCTTCTA
GAACTGAAATAGAGGGTACACAAAAGCTTCTGAACAAAGATTTGGCTGAATTGATTAATAAGATG
AGATTGGCACAACAGAACGCCGTTACTTCTTTGTCTGAGGAGTGTAAGAGACAAATGCTAACTGC
TTCTCATACTTTGGCTGTTGATGCAAGAACTTGTTAGACGCTGTGGATCAAGCAAAAGTTTTAG
CCAATTTGGCTCACCCACCTGCCGAAGGTTCTGCTGGATCAGCTGCAGGATCCGGCGAATTTGG
TTCTGCTGAAGCCGCTGCAAAAGAGGCTGCTGCAAAAGCTGGATCTGCAGGTAGTGCTGCTGGT
AGCGGAGAATTTGGTTCTGGTGCCATGGCTACTCCTGGTTCAGAAAACGTTCTACCAAGAGAAC
CATTGATTGCAACAGCCGTGAAGTTCTTGCAGAACTCTAGAGTTAGACAATCTCCATTGGCAACT
AGAAGAGCATTTTTGAAAAAGAAAGGTTTGACCGACGAGGAAATTGATATGGCTTTCCAACAGTC
CGGTACTGCAGCCGATGAACCATCTTCATTGTGGGGAAGTGGC
```

Figure 14D

Codon-optimized SCF Gene Cassette Nucleotide Sequences

1. Cannabinoidergic Metabolon Scaffold (CBSCFLD) – (Myc)₃

```
ATGGGTTCTGCTGGTTCAGCTGCAGGTTCTGGTGAATTCGGTTCCGCTGGTAGTGCCGCTGGTT
CTGGTGAATTTGGTTCTGCTGGTTCAGCAGCCGGTTCTGGTGAATTCTCCTATTACCATCACCAT
CACCATCACTTGGAATCTACTTCATTATACAAAAAGGCTGGTTCCGGTAGTGCCAGAAACGCTTA
CTTGAGAAAGAAAATTGCTAGATTGAAGAAAGATAATTTGCAATTGGAAAGAGATGAACAAAACTT
GGAAAAGATTATCGCTAATTTGAGAGATGAAATAGCAAGATTGGAAAATGAAGTTGCTTCTCATG
AACAAGGTTCCGCAGGTAGTGCCGCCGGTTCTGGTGAATTTGCTGAAGCCGCTGCAAAGGAAG
CCGCTGCAAAGCAGGTTCTGCCGGTTCAGCCGCTGGTAGTGGTGAATTTTCTTACTATCACCAT
CACCATCATCACTTGGAATCTACCTCATTATATAAAAAGGCCGGTTCCGGTAGTAACTTGGTTGC
TCAATTAGAAAATGAAGTCGCATCATTGGAAAACGAAAACGAAACTTTGAAAAGAAAAACTTACA
TAAGAAAGATTTGATCGCTTACTTAGAAAAGGAAATAGCAAATTTGAGAAAGAAAATAGAAGAAG
GTTCCGCTGGTAGTGCAGCCGGTAGTGGTGAATTCGGTTCTGCTGAAGCTGCAGCCAAGGAAG
CTGCAGCCAAAGAAGCCGCTGCTAAAGAAGCTGCAGCCAAAGCTGGTTCTGCAGGTTCTGCCG
CAGGTTCCGGTGAATTTGGTTCTTCATACTATCACCATCACCACCACCACTTGGAATCTACCTCA
TTATACAAGAAAGCTGGTTCCGGTAGTCAAAAGGTCGCTGAATTGAAAAACAGAGTAGCTGTTAA
GTTGAACAGAAACGAACAATTGAAAAATAAGGTAGAAGAATTGAAAAATAGAAACGCTTACTTGA
AAAACGAATTGGCAACTTTGGAAAACGAAGTAGCTAGATTAGAAAACGATGTTGCTGAAGGTTCT
GCTGGTTCTGCTGCTGGTTCTGGTGAATTCGCTGAAGCAGCCGCTAAGGAAGCAGCCGCTAAA
GCCGGTTCCGCCGGTTCTGCTGCGGGCTCTGGTGAATTTTCCTACTATCACCATCATCACC
ACTTGGAATCTACATCATTATATAAGAAAGCCGGTTCCGGTAGTAATGAAGTTACTACATTGGAAA
ACGATGCTGCTTTTATTGAAAACGAAACGCATACTTAGAAAAGGAAATCGCTAGATTGAGAAAG
GAAAAGGCCGCTTTGAGAAATAGATTAGCTCATAAGAAAGGTTCTGCTGGTAGCGCTGCTGGCT
CTGGTGAATTTGGTTCCGCCGAAGCCGCTGCTAAGGAAGCCGCTGCCAAAGAAGCCGCTGCCA
AGGAAGCCGCTGCTAAGGCTGGTTCCGCCGGTTCAGCTGCAGGCTCTGGTGAATTCGGTTCTA
GACCACCTACCATCTCTAATCCACCTCCATTGATTTCCAGTGCTAAACATCCATCCGTCGGTAGT
GCAGGTTCCGCTGCCGGCTCTGGCGAATTTGCCGAAGCTGCTGCCAAAGAAGCAGCCGCTAAA
GCTGGTTCAGCAGGTTCCGCTGCCGGATCTGGCGAATTCAATTTCTTGCAATCTAGACCAGAAC
CTACTGCTCCTCCAGAAGAAAGTTTCAGATCTGGTGGTTCAGCTGGTTCCGCCGCAGGATCTGG
CGAATTTGGTTCCGCAGAAGCTGCCGCTAAAGAAGCTGCTGCAAAAGAAGCAGCCGCCAAAGAA
GCTGCTGCAAAAGCCGGTAGTGCTGGTTCAGCTGCCGGTTCCGGTGAATTCGGTTCTTCAAAAG
GTACCGGTTTAAATCCAAACGCTAAAGTTTGGCAAGAAATTGCTCCTGGTAACGGTTCTGCAGGT
TCCGCAGCTGGTTCCGGTGAATTCGCCGAGGCCGCTGCTAAGGAAGCAGCAGCCAAAGCAGGT
AGTGCTGGTTCCGCAGCTGGTTCAGGTGAATTCCCAGACGGTGGTACCACTTTCGAACATTTGT
GGTCCAGTTTAGAACCTGATTCTACATACGGTTCTGCCGGTTCTGCAGCAGGCAGCGGTGAATT
CGGTTCTGCCGAAGCTGCTGCTAAAGAAGCTGCTGCCAAGGAAGCTGCTGCTAAGGAAGCTGC
TGCCAAAGCCGGTAGTGCAGGTTCTGCTGCCGGTTCAGGTGAATTTGGTTCTTCTTACTATCACC
ACCACCACCATCACTTGGAATCTACATCATTACAAGAAAGCCGGTTCTGGTAGTAAGAGAATC
GCATACTTAAGAAAGAAAATCGCTGCATTGAAGAAAGATAACGCAAACTTAGAAAAGGACATCGC
TAACTTGGAAAACGAAATCGAAAGATTGATTAAAGAAATCAAAACCTTGGAAAATGAAGTTGCATC
TCATGAACAAGGTTCAGCCGGTTCTGCAGCGGGCTCCGGTGAATTTGCCGAAGCTGCAGCAAAA
GAAGCTGCCGCTAAGGCTGGTAGTGCTGGTTCTGCTGCAGGCAGCGGTGAATTTTCTTACTACC
ACCATCACCACCATCACTTGGAATCTACTTCATTATATAAGAAAGCAGGTTCTGGTAGTAACTTGT
TAGCAACATTAAGATCTACCGCTGCAGTCTTGGAAAACGAAACCATGTATTGGAAAAGAAAAG
GAAAAATTGAGAAAGGAAAAAGAACAATTGTTGAATAAGTTGGAAGCTTACAAAGGTTCAGCAGG
TTCTGCAGCGGGCTCTGGCGAATTCGGTTCCGCCGAAGCTGCAGCAAAGGAAGCTGCAGCTAA
AGAGGCCGCTGCAAAAGAAGCTGCTGCCAAAGCAGGTAGTGCAGGTTCCGCAGCCGGCTCCG
GCGAATTTGGTTCACCAGCTACATCCCAACATCCTCCACCTCCACCTGGTCATAGATCTCAAGCT
CCTTCACATGGTTCCGCAGGTAGTGCAGCTGGATCTGGCGAATTCGCCGAAGCTGCCGCTAAG
```

Figure 14D (continued)

```
GAAGCTGCTGCAAAAGCTGGTTCCGCTGGTTCAGCAGCAGGTTCCGGTGAATTCGAATTGAATT
CTTTGTTGATATTGTTAGAAGCAGCCGAATATTTGGAAAGAAGAGATAGAGGTTCTGCCGGTAGT
GCTGCAGGTAGCGGCGAATTTGGTTCTGCAGAAGCAGCCGCCAAGGAAGCAGCTGCAAAAGAA
GCAGCAGCTAAAGAAGCAGCTGCAAAAGCCGGTTCTGCTGGTTCAGCCGCAGGATCTGGAGAA
TTCGGTTCCAGACCACCTACAATTTCCAATCCACCTCCATTGATCTCTTCTGCCAAGCATCCATC
CGTTGGTAGTGCAGGTTCAGCTGCCGGTAGTGGTGAATTTGCCGAAGCCGCCGCTAAGGAAGC
CGCCGCCAAAGCAGGTTCAGCCGGTTCCGCCGCAGGTTCAGGTGAATTCAATTTCTTGCAGTCA
AGACCAGAACCTACCGCTCCTCCAGAGGAGAGTTTCAGATCTGGTGGTAGTGCCGGTTCAGCTG
CCGGCTCTGGAGAATTTGGTTCTGCAGAGGCTGCTGCCAAGGAAGCCGCAGCTAAAGAAGCCG
CTGCGAAAGAAGCCGCCGCTAAAGCTGGTAGTGCAGGTAGTGCTGCGGGATCTGGCGAATTCG
GTTCTTCTAAGGGTACTGGTTTGAACCCTAATGCCAAGGTCTGGCAAGAAATCGCCCCTGGTAA
CGGTTCCGCAGGTTCCGCCGCAGGTAGTGGTGAATTCGCCGAGGCTGCCGCCAAGGAAGCCG
CCGCTAAGGCAGGTAGTGCTGGTTCAGCGGCCGGCTCTGGTGAATTTCCAGACGGTGGTACAA
CCTTTGAGCATTTGTGGTCCAGTTTAGAACCTGATTCTACGTACGGTTCTGCTGGTTCCGCTGCA
GGATCTGGCGAATTCGGTTCCGCGGAAGCCGCCGCAAAAGAAGCCGCCGCCAAAGAAGCCGC
CGCAAAGGAAGCCGCAGCAAAGGCAGGTAGTGCCGGCTCCGCCGCTGGCAGTGGCGAATTTG
GTTCTTCATATTATCACCATCATCATCATCACTTGGAATCTACTTCATTATACAAGAAAGCAGGTT
CCGGTTCTAAAAGAATTGCTTACTTAAGAAAGAAAATCGCGGCTTTGAAGAAAGACAATGCTAAC
TTAGAAAAGATATTGCCAACTTGGAAAATGAAATCGAAAGATTAATTAAGGAAATTAAAACATTG
GAAAACGAAGTTGCATCACATGAACAAGGTTCAGCTGGTTCCGCTGCAGGGTCCGGCGAATTTG
CAGAAGCCGCCGCCAAGGAAGCCGCAGCCAAAGCTGGTAGTGCAGGTTCTGCCGCTGGCTCTG
GCGAATTTTCTTACTATCATCATCACCATCACCACTTGGAATCTACTTCATTATACAAGAAAGCGG
GTTCAGGTTCTAACTTGTTAGCAACTTTAAGATCTACAGCCGCTGTTTTAGAAAATGAAACCATG
TCTTAGAAAAAGAAAAGGAAAAGTTGAGAAAGGAAAAGGAACAATTATTAAATAAGTTAGAAGCC
TACAAGGGTTCAGCAGGTTCCGCAGCAGGCTCAGGCGAATTTGGTTCTGCAGAAGCGGCTGCT
AAGGAAGCTGCCGCAAAGGAAGCAGCTGCTAAGGAGGCCGCTGCAAAGGCTGGTTCTGCTGGT
TCCGCCGCGGGCTCTGGAGAATTCGGTTCCGCTTTGGTTGATGACGCCGCTGATTATGAACCTC
CACCTTCAAATAACGAAGAAGCTTTAGGTTCCGCTGGTTCCGCTGCAGGTTCCGGCGAGTTCGC
AGAAGCCGCAGCAAAAGAAGCCGCAGCTAAGGCAGGTAGTGCCGGATCCGCCGCTGGCAGTG
GAGAATTCAGAGAATTGTTCGATGACCCATCTTACGTCAACGTACAAAATTTGGATAAAGCTAGA
CAAGGTTCCGCCGGTTCTGCAGCGGGATCTGGGGAATTTGGTTCTGCAGAAGCTGCCGCCAAA
GAAGCTGCAGCTAAAGAAGCCGCAGCCAAAGAAGCTGCTGCTAAGGCCGGTTCTGCTGGTTCT
GCCGCAGGATCTGGGGAATTCGGTTCCAAGAATACTAAGAGTATGAACTTCGATAACCCAGTTTA
CAGAAAGACTACAGAAGAAGAAGGTTCAGCCGGTTCAGCCGCCGGTTCCGGTGAATTTGCAGA
GGCTGCCGCTAAAGAGGCTGCCGCTAAGGCCGGTAGTGCTGGTTCTGCAGCCGGCTCCGGAG
AATTCAGATCTTTGCCATCCACATGGATTGAAAACAAATTATACGGCATGTCAGACCCTAATTGG
GGTTCTGCAGGTTCAGCTGCGGGATCTGGTGAATTCGGTTCAGCAGAAGCCGCAGCCAAGGAA
GCCGCTGCAAAGGAGGCCGCTGCCAAAGAAGCAGCTGCTAAGGCTGGTTCAGCCGGTTCCGCA
GCCGGCAGTGGTGAATTTGGTAGTGTTGTCGATAATTCTCCACCTCCAGCTTTGCCTCCAAAGAA
AAGACAATCTGCTCCATCTGGTTCAGCAGGTTCAGCCGCTGGTTCAGGTGAATTTGCCGAAGCA
GCTGCCAAGGAAGCTGCCGCCAAGGCGGGCAGTGCAGGTTCGGCTGCGGGGTCTGGTGAATT
CACTCAAAGATCTAAACCACAACCTGCAGTTCCTCCAAGACCATCTGCTGACTTGATTTTAGGTT
CCGCCGGTTCCGCAGCTGGCTCTGGCGAATTCGGTTCCGCTGAGGCTGCCGCTAAAGAAGCGG
CCGCTAAAGAGGCAGCCGCTAAAGAGGCGGCCGCTAAAGCAGGTTCTGCAGGTTCAGCAGCAG
GTAGTGGTGAATTTGGTTCTACAGATGAAGAAAGAAGAAACCGAAGAAGAAGTTTATTTGTTG
AACTCTACCACTTTGGGTTCAGCTGGTTCTGCTGCGGGTTCTGGCGAATTTGCAGAAGCAGCTG
CTAAGGAAGCCGCGGCAAAGGCTGGTTCTGCGGGCTCCGCCGCAGGTTCTGGTGAATTTGATG
GTAATGTATCTGGTACTCAAAGATTAGACTCAGCTACCGTTAGAACTTATTCATGCGGTTCTGCC
GGTAGTGCAGCGGGCTCTGGGGAATTCGGTTCCGCAGAAGCCGCTGCAAAAGAAGCCGCTGCA
```

Figure 14D (continued)

```
AAAGAAGCCGCTGCGAAGGAGGCTGCTGCTAAGGCAGGTTCCGCCGGTAGTGCTGCGGGTTCC
GGCGAATTTGGTTCCAGTTACTATCACCATCATCACCACCACTTGGAATCCACAAGTTTATATAA
GAAAGCTGGTTCTGGTTCACAAAAGGTAGCTCAATTGAAAAATAGAGTTGCATACAAGTTGAAGG
AAAACGCTAAGTTGGAAAACATAGTAGCAAGATTAGAAAACGATAACGCTAATTTGGAAAAGGAC
ATCGCAAATTTGGAAAAGGATATAGCTAACTTGGAAAGAGATGTTGCTAGAGGTTCTGCTGGTAG
TGCCGCAGGCTCTGGCGAATTCGCTGAAGCTGCCGCTAAAGAGGCTGCGGCTAAAGCTGGTTC
AGCTGGTTCTGCAGCGGGGTCTGGTGAATTTTCTTATTATCACCATCATCACCATCACTTGGAAT
CCACCAGTTTATACAAGAAAGCCGGCTCTGGTTCAAACACTGTTAAGGAATTGAAAAATTACATT
CAAGAATTGGAAGAAAGAAACGCTGAATTGAAAAATTTGAAGGAACATTTGAAGTTTGCAAAAGC
CGAATTGGAATTCGAATTAGCAGCCCATAAATTTGAAGGTTCTGCCGGTTCTGCCGCCGGATCT
GGAGAATTTGGTTCTGCGGAGGCTGCCGCTAAAGAAGCCGCCGCTAAAGAGGCTGCAGCTAAG
GAAGCTGCAGCAAAGGCTGGTTCTGCCGGTTCCGCTGCCGGCTCCGGCGAATTTGGTTCACAT
GATGACTCCTTGCCACATCCTCAACAAGCTACAGATGACTCTGGTCATGAATCCGACGGTTCCG
CAGGCTCTGCTGCCGGCTCCGGCGAGTTTGCTGAAGCCGCTGCTAAAGAGGCTGCTGCTAAAG
CCGGTTCTGCCGGTTCAGCAGCTGGATCTGGAGAATTTGGTTCCCCAAATGCTGGTAGTGTTGA
ACAAACCCCAAAGAAACCTGGTTTGAGAAGAAGAGGTAGTGCTGGTTCTGCCGCTGGCTCCGGA
GAATTTGGTTCAGCCGAAGCTGCGGCCAAAGAGGCTGCTGCAAAGGAGGCTGCGGCTAAGGAA
GCCGCCGCTAAAGCCGGTTCAGCTGGTTCCGCGGCAGGCTCCGGGGAATTTGGTTCTTCTTATT
ATCACCACCACCACCATCACTTGGAATCCACTAGTTTATACAAGAAAGCAGGCTCTGGTTCATTC
GAAAACGTCACTCATGAATTCATTTTGGCAACCTTAGAAAACGAAAACGCTAAGTTGAGAAGATT
AGAAGCAAAGTTGGAAAGAGAATTGGCTAGATTAAGAAATGAAGTAGCTTGGTTGGGTTCTGCG
GGCTCGGCCGCTGGCTCTGGTGAATTCGCCGAAGCTGCGGCCAAGGAGGCTGCCGCAAAGGC
CGGTTCTGCCGGTTCCGCAGCGGGATCCGGCGAATTTTCTTACTACCATCATCACCATCACCAC
TTGGAATCCACAAGTTTATACAAGAAAGCGGGTTCTGGTTCACAAAAAGTTGAAGAATTGAAAAA
TAAGATAGCAGAATTGGAAAACAGAAACGCTGTAAAGAAAAATAGAGTTGCACATTTGAAGCAAG
AAATCGCTTACTTGAAGGATGAATTAGCAGCCCATGAATTCGAAGGTAGTGCCGGTTCCGCTGC
TGGCTCAGGCGAATTTGGTAGTGCAGAAGCTGCCGCTAAGGAGGCTGCCGCCAAAGAAGCAGC
CGCAAAAGAAGCTGCCGCAAAAGCCGGTTCTGCGGGCTCTGCTGCCGGATCCGGCGAATTCGG
TTCAGTCTCCAGTACTAAATTAGTATCCTTTCATGATGACAGTGATGAAGACTTGTTACATATCGG
TTCTGCAGGCTCAGCCGCTGGCTCTGGAGAGTTTGCAGAGGCAGCTGCTAAAGAAGCCGCCGC
AAAGGCAGGTTCTGCAGGTTCTGCAGCTGGTAGTGGTGAATTCGCTGCTGCAACCCCAATATCT
ACTTTTCATGATGACTCAGACGAAGACTTGTTGCATGTCGGTTCCGCAGGTTCAGCAGCGGGAT
CCGGTGAATTTGGTTCAGCAGAAGCTGCCGCCAAGGAGGCCGCTGCTAAAGAAGCAGCAGCCA
AGGAAGCAGCAGCAAAGGCCGGCTCTGCTGGTTCTGCTGCCGGGTCCGGCGAATTTGGTTCTT
CTTATTACCACCATCATCATCACCACTTGGAATCCACTAGTTTATATAAGAAAGCCGGTTCTGGTT
CACAAAAGGTGGAATCATTAAAACAAAAGATTGAAGAATTGAAGCAAAGAAAAGCACAATTGAAA
AATGATATTGCCAATTTGGAAAAGGAAATCGCTTACGCAGAAACAGGTAGTGCCGGTTCAGCCG
CGGGCTCTGGTGAATTCGCAGAAGCTGCCGCAAAAGAAGCTGCAGCAAAAGCCGGTTCTGCAG
GCTCTGCTGCTGGCTCTGGCGAATTTTCCTACTATCATCATCATCATCACTTGGAATCCACA
AGTTTATACAAGAAAGCGGGTAGTGAATTTTTCAGAAGAGAAAGAAACAAGATGGCAGCCGCTAA
GTGTAGAAACAGAAGAAGAGAATTGACTGATACATTACAAGCTGAAACAGATCAATTAGAAGACG
AAAAATCAGCTTTGCAAACCGAAATCGCAAATTTGTTGAAAGAAAAGAAAAATTGGAATTCATTT
TAGCAGCCCATAGACCAGCTTGCAAAATACCTGATGACTTGGGTTTTCCAGAAGAAATGTCTTTA
GAAGGTAGTGCCGGTAGTGCCGCTGGCTCAGGTGAATTTGGTAGTGCAGAAGCTGCCGCGAAA
GAAGCCGCAGCTAAAGAAGCTGCCGCCAAAGAGGCAGCCGCAAAGGCAGGTTCAGCAGGTTCA
GCTGCCGGGTCCGGGGAATTTGGTTCATTCCAAATGCCAGCTGACACTCCTCCACCTGCATATT
TGCCACCTGAAGATCCTATGACAGGTAGTGCCGGTTCTGCTGCCGGGTCTGGCGAATTCGCTGA
AGCCGCTGCTAAGGAGGCTGCAGCTAAGGCCGGCTCTGCAGGTTCCGCTGCAGGTTCAGGTGA
ATTTGAAAGAGAATCTAACGAAGAACCACCTCCACCTTATGAAGATCCATACTGGGGTAATGGTG
```

Figure 14D (continued)

GTTCTGCCGGTAGTGCCGCCGGCTCAGGCGAATTTGGTTCTGCGGAGGCTGCTGCAAAGGAAG
CTGCGGCCAAGGAAGCTGCCGCAAAAGAGGCTGCTGCCAAGGCCGGTTCAGCAGGTTCAGCA
GCTGGGTCCGGTGAATTTGGTTCCAGTTATTATCACCACCATCATCACCACTTGGAATCTACCTC
ATTATATAAGAAAGCGGGTTCCGGTAGTCAAAAAGTTGCAGAATTGAAAAACAGAGTTGCTGTCA
AATTAAATAGAAATGAGCAGTTGAAAAATAAGGTCGAGGAGTTGAAAAATAGAAACGCATACTTG
AAAAATGAATTGGCTACTTTGGAAAACGAAGTCGCAAGATTAGAAAATGATGTAGCTGAAGGCTC
TGCTGGTTCCGCAGCGGGCTCAGGTGAATTCGCCGAAGCAGCCGCAAAGGAAGCTGCCGCTAA
GGCCGGCTCAGCAGGTTCTGCCGCCGGAAGCGGTGAATTTTCTTATTACCACCACCACCATCAC
CACTTGGAATCTACTTCATTATACAAGAAAGCGGGGTCCGGTAGTAACGAAGTCACAACCTTAGA
AAATGATGCAGCCTTTATAGAAAACGAAAATGCCTACTTAGAAAAAGAAATTGCAAGATTGAGAA
AGGAAAAAGCTGCATTGAGAAACAGATTAGCCCACAAGAAATCTTACTATCACCACCATCATCAT
CACTTGGAATCTACATCATTATACAAGAAAGCGGGCTCCGGTAGTGCTAGAAATGCCTACTTAAG
AAAGAAAATAGCCAGATTGAAGAAAGACAATTTGCAATTAGAGAGAGATGAACAGAACTTAGAAA
AGATTATAGCCAATTTGAGAGATGAAATTGCTAGATTAGAAAATGAAGTAGCTTCTCATGAACAAG
GTAGTGCTGGCTCCGCTGCCGGCTCCGGAGAATTTGCCGAAGCTGCCGCCAAGGAAGCCGCG
GCCAAGGCTGGTTCCGCTGGTTCTGCTGCCGGATCTGGAGAATTTTCCTATTACCATCATCATCA
TCATCATTTGGAATCTACATCATTATACAAGAAAGCGGGATCTGGTTCTAACTTGGTCGCCCAATT
GGAGAACGAAGTCGCATCATTGGAGAACGAAAACGAAACCTTGAAGAAAAGAACTTACACAAA
AAGGATTTGATAGCTTACTTAGAAAAGAAATCGCTAATTTGAGAAAGAAAATTGAAGAAGGTAGT
GCAGGTTCAGCCGCTGGCTCCGGTGAATTTGGTTCAGCGGAGGCTGCCGCTAAGGAGGCAGCC
GCTAAAGAAGCAGCCGCTAAGGAGGCTGCAGCAAAAGCAGGTTCCGCAGGTTCTGCAGCGGGT
TCCGGAGAATTTGGTTCTGAACAAAAGTTGATCTCTGAAGAAGATTTGGAACAAAAGTTGATATC
TGAAGAAGACTTGGAACAAAAATTAATATCAGAAGAAGATTTGGGTAGTGCAGGTTCAGCAGCTG
GTTCTGGAGAATTTGGTTCAGCAGGTTCTGCCGCTGGAAGTGGCGAATTCGGTAGTGCCGGCTC
CGCTGCTGGCTCTGGCGAATTTGGTTCTGGT

2. <u>Malonyl-CoA Metabolon Scaffold (MCASCFLD) – (FLAG)$_3$</u>

ATGGGTTCTGCTGGTTCAGCTGCAGGTTCTGGTGAATTTGGTTCCGCAGGTAGTGCCGCTGGTT
CTGGTGAATTCGGTTCTGCTGGTTCAGCAGCCGGTTCTGGTGAATTTTCATATTACCATCACCAT
CACCATCACTTGGAATCCACCAGTTTATACAAAAAGGCTGGTTCTGGTTCAGCTAGAAACGCATA
TTTGAGAAAGAAAATTGCTAGATTGAAGAAAGATAACTTGCAATTGGAAAGAGATGAACAAAATTT
GGAAAAGATTATCGCCAACTTAAGAGATGAAATAGCAAGATTGGAAAACGAAGTAGCTTCTCATG
AACAAGGTTCCGCAGGTAGTGCAGCTGGTTCTGGTGAATTTGCTGAAGCCGCTGCAAAGGAAGC
CGCTGCAAAAGCTGGTTCCGCTGGTTCAGCCGCTGGTTCCGGTGAATTCAGTTACTATCACCAT
CACCATCATCACTTGGAATCCACTAGTTTATATAAAAAGGCCGGTTCTGGTTCAAATTTGGTTGCT
CAATTAGAAAACGAAGTCGCATCTTTAGAAAACGAAAACGAAACATTGAAAAGAAAAATTTGCAT
AAGAAAGATTTGATCGCTTATTTGGAAAAGGAAATCGCAAACTTGAGAAAGAAAATAGAAGAAGG
TTCCGCTGGTTCTGCTGCTGGTTCCGGTGAATTTGGTTCAGCTGAAGCTGCAGCCAAGGAAGCT
GCAGCCAAAGAAGCCGCTGCTAAAGAAGCTGCAGCCAAAGCAGGTTCTGCCGGTTCTGCCGCA
GGTTCCGGTGAATTCGGTTCTTCAGCTACTAGAGAATTGGATGAATTGATGGCATCCTTAAGTGA
CTTCAAGATACAAGGTGGTTCCGCTGGTTCTGCAGCCGGCTCTGGCGAATTCGCAGAAGCAGC
CGCTAAGGAAGCAGCCGCTAAAGCTGGTTCTGCAGGTTCTGCTGCCGGTTCTGGTGAATTCGAT
TTGGCTTTGTCTGAAAACTGGGCACAAGAATTCTTGGCTGCAGGTGACGCTGTTGATGGTTCTG
CTGGTAGTGCTGCCGGTTCAGGTGAATTTGGTAGTGCTGAAGCTGCTGCCAAAGAAGCAGCCG
CTAAAGAAGCTGCTGCCAAGGAAGCTGCCGCTAAAGCAGGTTCCGCCGGTTCTGCCGCCGGCT
CCGGCGAATTTGGTTCAGATTATAAGGATGACGATGACAAGGATTACAAAGACGATGATGACAA
GGATTATAAAGATGACGATGACAAAGGTTCCGCTGGTAGTGCCGCCGGCTCTGGAGAATTCGGT
TCTGCCGGTTCAGCTGCCGGCTCCGGAGAATTTGGTTCCGCTGGTAGTGCAGCCGGTTCAGGT
GAATTCGGTTCTGGT

Figure 15A

Complete HCA Gene Cassette Nucleotide Sequence

ATGAGTGCTAAGGCAATTTCTGAACAAACTGGTAAAGAATTGTTGTACAAGTTTATTTGTACTACA
TCAGCCATCCAAAATAGATTCAAATACGCTAGAGTTACCCCAGATACTGACTGGGCTAGATTGTT
ACAAGATCATCCATGGTTGTTATCTCAAAACTTGGTTGTCAAACCTGACCAATTAATTAAGAGAAG
AGGTAAATTGGGTTTAGTAGGTGTTAATTTGACATTGGATGGTGTAAAGTCTTGGTTGAAACCAA
GATTAGGTCAAGAAGCCACAGTTGGTAAAGCTACCGGTTTCTTGAAAAATTTCTTGATCGAACCA
TTTGTCCCTCATTCACAAGCCGAAGAATTCTATGTATGTATCTACGCTACTAGAGAGGGTGACTA
TGTTTTATTTCATCACGAAGGTGGTGTCGACGTAGGTGACGTTGACGCCAAGGCTCAAAAGTTGT
TGGTTGGTGTCGATGAAAAGTTGAACCCAGAAGACATTAAAAAGCATTTGTTGGTTCACGCACCT
GAAGATAAAAAGGAAATATTGGCCTCCTTTATAAGTGGTTTGTTTAATTTCTACGAAGATTTGTAC
TTCACCTACTTGGAAATTAACCCATTAGTAGTTACTAAGGATGGTGTATATGTTTTGGACTTAGCT
GCAAAAGTTGATGCAACAGCCGACTACATTTGTAAGGTCAAATGGGGTGACATCGAATTTCCACC
TCCATTCGGTAGAGAAGCTTATCCAGAAGAAGCCTACATTGCTGATTTGGACGCTAAGTCTGGTG
CATCATTGAAGTTGACATTGTTGAACCCTAAAGGTAGAATTTGGACCATGGTTGCTGGTGGTGGT
GCTAGTGTCGTATATTCTGATACTATATGCGACTTGGGTGGTGTTAACGAATTGGCAAACTACGG
TGAATACTCAGGTGCCCCATCCGAACAACAAACATACGATTACGCTAAGACCATCTTGTCCTTAA
TGACTAGAGAAAAGCATCCTGATGGTAAAATCTTGATCATCGGTGGTAGTATCGCAAATTTTACT
AACGTTGCCGCTACATTCAAGGGTATCGTCAGAGCTATAAGAGATTACCAAGGTCCATTGAAGG
AACACGAAGTAACAATATTCGTTAGAAGAGGTGGTCCTAACTACCAAGAAGGTTTGAGAGTCATG
GGTGAAGTAGGTAAAACCACTGGTATACCAATCCATGTCTTTGGTACAGAAACCCACATGACTGC
AATAGTTGGTATGGCCTTAGGTCATAGACCAATCCCTAATCAACCTCCAACCGCAGCCCACACTG
CAAATTTCTTGTTAAACGCCTCTGGTTCAACTTCCACACCAGCTCCTTCTAGAACAGCAAGTTTCT
CTGAATCAAGAGCTGATGAAGTCGCTCCAGCTAAGAAAGCAAAACCAGCCATGCCTCAAGACTC
CGTTCCAAGTCCTAGATCTTTGCAGGGTAAATCTACTACTTTGTTTTCTAGACATACTAAGGCTAT
AGTATGGGGTATGCAAACAAGAGCAGTTCAAGGCATGTTGGATTTCGACTATGTTTGTAGTAGAG
ATGAACCATCTGTTGCTGCAATGGTCTATCCTTTTACTGGTGACCATAAGCAAAAATTCTACTGG
GGTCACAAGGAAATATTGATCCCAGTTTTTAAGAACATGGCCGATGCTATGAGAAAACATCCTGA
AGTCGACGTATTGATTAACTTCGCCTCATTAAGATCCGCTTACGATTCTACAATGGAAACCATGA
ACTACGCTCAAATAAGAACCATCGCTATCATTGCAGAAGGTATTCCAGAAGCCTTGACTAGAAAG
TTGATTAAGAAAGCTGATCAAAAGGTGTCACAATAATCGGTCCAGCTACCGTAGGTGGTATTAA
GCCTGGTTGTTTCAAGATCGGTAACACTGGTGGTATGTTGGATAACATATTGGCATCTAAGTTGT
ATAGACCAGGTTCAGTCGCTTACGTATCCAGAAGTGGTGGTATGTCCAACGAATTGAACAACATC
ATCAGTAGAACTACAGATGGTGTATACGAAGGTGTTGCTATTGGTGGTGACAGATACCCAGGTT
CTACTTTTATGGATCATGTATTGAGATATCAAGACACACCTGGTGTTAAAATGATTGTTGTCTTGG
GTGAAATAGGTGGTACTGAAGAATACAAGATATGCAGAGGTATCAAAGAAGGTAGATTGACAAA
GCCAATCGTTTGTTGGTGCATTGGTACTTGTGCAACAATGTTTTCTTCAGAAGTTCAATTCGGTCA
TGCAGGTGCCTGCGCTAATCAAGCTTCAGAAACAGCAGTTGCCAAGAACCAAGCATTAAAAGAA
GCCGGTGTTTTTGTCCCTAGATCTTTCGATGAATTAGGTGAAATCATTCAATCAGTCTATGAAGAC
TTGGTAGCTAATGGTGTAATTGTTCCAGCACAAGAAGTTCCTCCACCTACTGTCCCTATGGATTA
CTCTTGGGCAAGAGAATTGGGTTTAATTAGAAAGCCAGCTAGTTTTATGACCTCTATATGTGATG
AAAGAGGTCAAGAATTGATCTATGCTGGTATGCCTATTACTGAAGTATTCAAAGAAGAAATGGGT
ATCGGTGGTGTTTTAGGTTTGTTGTGGTTCCAAAAGAGATTGCCAAAGTACTCTTGTCAATTCATT
GAAATGTGCTTAATGGTTACAGCTGATCATGGTCCTGCTGTCTCAGGTGCACACAATACCATAAT
CTGCGCTAGAGCTGGTAAAGATTTGGTTTCTTCTTTGACCTCAGGTTTGTTAACTATTGGTGACA
GATTTGGTGGTGCATTAGACGCCGCTGCAAAGATGTTTTCAAAAGCTTTCGATTCCGGTATAATC
CCAATGGAATTCGTTAATAAGATGAAAAAGGAGGGTAAATTGATAATGGGTATCGGTCATCGTGT
TAAGTCTATCAATAACCCTGATATGAGAGTACAAATCTTGAAGGACTATGTTAGACAACACTTTCC
AGCCACACCTTTGTTAGATTACGCTTTGGAAGTTGAAAAGATTACCACTTCTAAAAAGCCAAATTT
GATCTTGAACGTTGATGGTTTAATTGGTGTTGCTTTTGTCGACATGTTGAGAAACTGTGGTTCCTT

Figure 15A (continued)

```
CACTAGAGAAGAAGCTGATGAATATATCGACATTGGTGCATTGAATGGTATCTTTGTTTTAGGTA
GATCTATGGGTTTCATTGGTCATTACTTGGATCAAAAGAGATTAAAGCAAGGTTTGTACAGACAT
CCATGGGATGACATTTCTTACGTTTTACCTGAACACATGTCAATGAAATTGTCTGGTGGTGGTGG
TTCTGGTGGTGGTGGTTCTGGTGGTGGTGGTAGTGCCGAAGCTTGGTACAATTTGGGTAACGCA
TACTACAAGCAGGGTGACTACCAAAAGGCAATTGAATATTACCAAAAGGCCTTGGAATTAGACCC
AAATAACGCAGAAGCCTGGTATAATTTGGGTAATGCTTATTATAAACAGGGTGACTATCAAAAGG
CTATCGAATACTACCAAAAGGCATTGGAATTAGACCCTAATAACGCTGAAGCATGGTATAATTTG
GGTAACGCTTATTATAAGCAGGGTGACTATCAAAAGCCATCGAAGACTACCAAAAGGCTTTGGA
ATTAGATCCAAATAACTTACAAGCCGAAGCTTGGAAGAATTTGGGTAACGCTTACTATAAACAGG
GTGACTACCAAAAAGCAATTGAATACTATCAAAAAGCTTTAGAATTGGACCCTAATAACGCATCA
GCCTGGTACAATTTGGGTAATGCTTACTATAAGCAGGGTGACTATCAGAAGGCCATTGAATACTA
TCAAAAGGCTTTAGAATTGGATCCAAATAACGCTAAAGCATGGTACAGACGTGGTAACGCTTATT
ACAAACAGGGTGACTACCAGAAAGCCATTGAAGATTATCAAAAGGCTTTGGAATTGGATCCTAAC
AACAGATCTAGATCAGCTGGTGGTGGTGGTTCTGGTGGTGGTGGTTCTGGTGGTGGTGGTGCTT
CTTCATATTACCATCACCATCACCATCACTTGGAATCCACAAGTTTATACAAAAAGGCTGGTTCTG
GTTCAAATTTGGTCGCACAATTGGAAAACGAAGTAGCCTCTTTAGAAAATGAAAACGAAACCTTG
AAAAAGAAAAACTTACATAAGAAAGATTTGATCGCTTATTTGGAAAAGGAAATCGCAAATTTGAGA
AAGAAAATTGAAGAAGGTAGTGCAGGTTCTGCCGCTGGTTCTGGTGAATTTGGTTCAGCTGAAG
CAGCCGCTAAGGAAGCAGCCGCTAAAGCCGGTTCAGCTGGTTCCGCAGCCGGTTCTGGTGAAT
TCGGTTCCAGTTACTATCACCATCACCATCATCACTTGGAATCCacaAGTTTATATAAGAAAGCAG
GTTCTGGTTCAGCAAGAAATGCCTACTTGAGAAAGAAAATAGCTAGATTAAAGAAAGATAACTTG
CAATTGGAAAGAGATGAACAAAATTTGGAAAAGATTATCGCCAACTTAAGAGATGAAATCGCTAG
ATTGGAAAATGAAGTTGCATCCCATGAACAAGGTAGTGGTGCTACTAACTTCTCTTTGTTGAAGC
AAGCAGGTGACGTTGAAGAAAATCCAGGTCCAATGAAAAACTGTGTAATCGTTTCTGCTGTTAGA
ACTGCAATTGGTTCCTTTAATGGTAGTTTGGCCTCTACATCAGCTATTGATTTGGGTGCTACCGT
CATCAAAGCTGCAATTGAAAGAGCAAAGATTGATTCTCAACATGTCGACGAAGTAATAATGGGTA
ACGTTTTGCAAGCTGGTTTAGGTCAAAATCCAGCAAGACAAGCCTTGTTAAAATCTGGTTTAGCA
GAAACTGTATGTGGTTTCACAGTTAATAAGGTCTGCGGTTCTGGTTTGAAGTCAGTTGCTTTAGC
CGCTCAAGCTATACAAGCAGGTCAAGCCCAATCTATCGTCGCTGGTGGTATGGAAAATATGTCAT
TGGCACCTTATTTGTTAGATGCAAAAGCCAGATCAGGTTATAGATTAGGTGACGGTCAAGTATAC
GACGTTATTTTGAGAGATGGTTTAATGTGCGCTACTCATGGTTATCACATGGGTATTACAGCAGA
AAATGTTGCCAAAGAATACGGTATAACCAGAGAAATGCAAGATGAATTGGCATTACATTCCCAAA
GAAAGGCAGCCGCTGCAATCGAAGTGGTGCTTTTACTGCAGAAATTGTCCCAGTAAACGTTGT
CACAAGAAAGAAAACTTTCGTTTTCTCCCAAGATGAATTCCCAAAAGCTAATAGTACCGCTGAAG
CATTGGGTGCTTTAAGACCTGCATTCGACAAGGCCGGTACCGTAACTGCCGGTAATGCTTCTGG
TATAAACGATGGTGCCGCTGCATTGGTTATCATGGAAGAATCAGCCGCTTTAGCAGCCGGTTTG
ACACCTTTAGCTAGAATTAAATCTTATGCATCAGGTGGTGTTCCACCTGCTTTGATGGGTATGGG
TCCAGTCCCTGCTACCCAAAAGGCATTGCAATTAGCCGGTTTGCAATTGGCTGATATCGACTTAA
TCGAAGCAAACGAAGCCTTTGCTGCACAATTCTTGGCAGTTGGTAAAAATTTGGGTTTCGACTCC
GAAAAGGTTAATGTCAACGGTGGTGCCATTGCTTTGGGTCATCCAATAGGTGCTTCAGGTGCAA
GAATCTTGGTTACATTGTTGCATGCCATGCAAGCTAGAGATAAAACCTTGGGTTTAGCTACTTTGT
GTATCGGTGGTGGTCAAGGTATCGCAATGGTTATCGAAAGATTGAATAAGTTGTCTGGTGGTGG
TGGTTCTGGTGGTGGTGGTTCTGGTGGTGGTGGTAGTGCAGAAGCCTGGTACAATTTGGGTAAC
GCTTACTACAAGCAGGGTGACTACCAAAAGGCAATCGAATACTACCAAAAGGCCTTGGAATTAG
ATCCAAATAACGCTGAAGCATGGTATAATTTGGGTAATGCCTATTATAAACAGGGTGACTATCAA
AAAGCTATTGAATATTACCAAAAGGCATTGGAATTAGATCCTAATAACGCCGAAGCTTGGTATAAT
TTGGGTAACGCCTATTATAAGCAGGGTGACTATCAAAAGGCCATCGAAGATTACCAAAAGGCTTT
GGAATTGGATCCAAACAACTTGCAAGCAGAAGCCTGGAAGAATTTGGGTAACGCTTATTACAAAC
AGGGTGACTACCAAAAAGCTATTGAATACTATCAAAAAGCCTTAGAATTGGATCCTAATAACGCTT
```

Figure 15A (continued)

```
CTGCATGGTACAATTTGGGTAATGCCTACTATAAACAGGGTGACTACCAGAAGGCTATTGAATAC
TACCAAAAAGCATTAGAATTGGATCCAAATAACGCCAAGGCTTGGTACAGACGTGGTAATGCCTA
TTACAAGCAGGGTGACTACCAGAAAGCCATAGAAGACTATCAAAAAGCCTTGGAATTGGATCCTA
ACAACAGATCCAGAAGTGCTGGTGGTGGTGGTTCTGGTGGTGGTGGTTCTGGTGGTGGTGGTG
CTTCTTCATATTACCATCACCATCACCATCACTTGGAATCTACATCATTATACAAAAAGGCTGGTT
CCGGTAGTAATGAAGTTACTACATTGGAAAACGATGCCGCTTTTATCGAAAACGAAAACGCATAC
TTGGAAAAGGAAATCGCCAGATTAAGAAAGGAAAAGGCAGCCTTGAGAAATAGATTAGCCCATA
AAAAGGGTTCCGCTGGTAGTGCTGCAGGTTCTGGTGAATTTGGTTCAGCTGAAGCCGCTGCAAA
AGAAGCCGCTGCAAAGGCAGGTTCTGCCGGTTCAGCCGCTGGTTCTGGTGAATTCGGTTCCAGT
TACTATCACCATCACCATCATCACTTGGAATCTACTTCATTATATAAAAAGGCCGGTTCCGGTAGT
CAAAAAGTCGCTGAATTAAAGAACAGAGTAGCTGTTAAGTTGAACAGAAACGAACAATTGAAAAA
TAAGGTAGAAGAATTGAAAAATAGAAACGCCTACTTAAAGAATGAATTGGCAACATTGGAAAACG
AAGTCGCTAGATTGGAAAATGATGTAGCAGAAGGTTCTGGTGCTACTAACTTCTCTTTGTTGAAG
CAAGCAGGTGACGTTGAAGAAAATCCAGGTCCAATGAAAAAGGTTTGTGTCATTGGTGCTGGTA
CCATGGGTTCTGGTATAGCACAAGCCTTTGCTGCAAAAGGTTTCGAAGTTGTCTTGAGAGATATC
AAGGACGAATTCGTTGATAGAGGTTTGGACTTCATCAATAAGAACTTGTCTAAGTTGGTTAAAAA
GGGTAAAATCGAAGAAGCTACAAAGGTAGAAATCTTGACCAGAATTTCAGGTACTGTTGATTTGA
ATATGGCCGCTGATTGTGACTTGGTAATCGAAGCAGCCGTTGAAAGAATGGATATTAAGAAACAA
ATCTTCGCAGATTTGGACAACATCTGCAAACCTGAAACAATCTTAGCCTCAAACACCTCTTCATTG
TCCATTACTGAAGTCGCTAGTGCAACAAAAAGACCAGATAAGGTAATAGGCATGCATTTCTTTAA
TCCAGCTCCTGTTATGAAGTTGGTAGAAGTTATTAGAGGTATAGCAACATCTCAAGAAACCTTTG
ACGCTGTTAAGGAAACTTCAATAGCAATCGGTAAAGATCCAGTCGAAGTAGCCGAAGCTCCTGG
TTTCGTAGTTAACAGAATCTTGATACCTATGATCAACGAAGCTGTTGGTATCTTGGCTGAAGGTAT
TGCATCTGTCGAAGATATTGACAAAGCCATGAAGTTAGGTGCTAATCACCCAATGGGTCCTTTGG
AATTGGGTGACTTTATTGGTTTGGACATATGTTTAGCTATCATGGACGTTTTGTATTCCGAAACAG
GTGACAGTAAATACAGACCACATACCTTGTTGAAGAAATATGTTAGAGCAGGTTGGTTAGGTAGA
AAGTCTGGTAAAGGTTTCTACGATTACTCTAAAAAGTTGTCTGGTGGTGGTGGTTCTGGTGGTGG
TGGTTCTGGTGGTGGTGGTAGTGCAGAAGCCTGGTACAATTTGGGTAACGCTTACTACAAGCAG
GGTGACTACCAAAAGGCCATAGAATACTACCAAAAGGCTTTGGAATTGGATCCTAATAACGCTGA
AGCATGGTATAATTTGGGTAATGCATATTATAAACAGGGTGACTATCAAAAGGCAATCGAATACT
ACCAAAAGGCCTTGGAATTAGATCCAAATAACGCCGAAGCTTGGTATAATTTGGGTAACGCCTAT
TATAAGCAGGGTGACTATCAAAAGCTATCGAAGATTACCAAAAGGCATTGGAATTGGATCCTAA
CAACTTACAAGCAGAAGCCTGGAAGAATTTGGGTAACGCATATTACAAACAGGGTGACTACCAAA
AAGCCATTGAATATTATCAAAAAGCTTTGGAATTGGATCCAAATAACGCTTCAGCATGGTACAATT
TGGGTAATGCCTATTACAAGCAGGGTGACTATCAGAAAGCTATTGAATATTATCAAAAGGCTTTG
GAATTAGATCCTAATAACGCCAAGGCTTGGTACAGACGTGGTAATGCCTATTACAAGCAGGGTG
ACTACCAGAAGGCCATTGAAGACTATCAAAAAGCCTTGGAATTGGATCCAAACAACAGATCTAGA
TCAGCTGGTGGTGGTGGTTCTGGTGGTGGTGGTTCTGGTGGTGGTGGTGCTTCCGAAAATTTGT
ACTTCCAAGGTGAAAACTTGTACTTCCAGGGTGACTCCAGTGAAAGTTGTTGGAATTGCGGTAGA
AAAGCCTCCGAAACCTGTAGTGGTTGCAACACTGCTAGATATTGTGGTTCTTTTTGCCAACACAA
AGATTGGGAAAAGCATCACCATATTTGTGGTCAAACATTACAAGCACAACAAGGTTCTGCCGGTT
CAGCTGCAGGTTCTGGTGAATTTGGTTCCGCTGAAGCCGCTGCAAAAGAAGCCGCTGCAAAGG
CAGGTTCCGCCGGTAGTGCCGCTGGTAGTGGTGAATTCGGTTCTATGGCAGTTTCCGAAAGTCA
ATTGAAGAAAATGGTTTCTAAGTACAAGTACAGAGATTTGACTGTTAGAGAAACAGTTAACGTCAT
CACTTTGTACAAGGATTTGAAGCCAGTCTTGGACTCATACGTTTTTAATGATGGTTCTTCAAGAGA
ATTGATGAACTTAACTGGTACAATACCAGTTCCTTACCGTGGTAACACTTACAACATCCCAATCTG
TTTGTGGTTGTTAGATACATATCCTTACAATCCACCTATCTGCTTCGTCAAACCAACATCCAGTAT
GACCATTAAAACTGGTAAACATGTTGATGCTAACGGTAAAATATATTTGCCATACTTACACGAATG
GAAGCATCCTCAATCAGACTTGTTGGGTTTAATCCAAGTAATGATCGTCGTATTTGGTGACGAAC
```

Figure 15A (continued)

```
CACCTGTTTTCTCTAGACCAGGTTCAGGTGCTACTAACTTCTCTTTGTTGAAGCAAGCAGGTGAC
GTTGAAGAAAATCCAGGTCCAATGGAATTGAACAACGTTATATTGGAAAAGGAGGGTAAAGTCG
CTGTTGTCACTATAAATAGACCAAAGGCATTGAACGCCTTGAACTCTGATACATTGAAGGAAATG
GACTACGTTATCGGTGAAATTGAAAACGATTCAGAAGTCTTAGCAGTAATTTTGACCGGTGCCGG
TGAAAAATCCTTTGTTGCCGGTGCTGATATCAGTGAAATGAAGGAAATGAACACTATCGAAGGTA
GAAAGTTCGGTATCTTGGGTAACAAGGTTTTCAGAAGATTGGAATTGTTGGAAAAGCCTGTTATA
GCTGCAGTCAATGGTTTCGCTTTGGGTGGTGGTTGTGAAATCGCAATGTCCTGCGATATTAGAAT
AGCTTCTTCAAACGCAAGATTTGGTCAACCAGAAGTCGGTTTAGGTATTACACCTGGTTTCGGTG
GTACCCAAAGATTATCTAGATTGGTTGGTATGGGTATGGCCAAGCAATTGATTTTTACTGCTCAA
AACATCAAGGCTGATGAAGCATTGAGAATCGGTTTGGTTAATAAGGTAGTTGAACCATCTGAATT
GATGAACACCGCCAAGGAAATCGCTAATAAGATTGTTTCTAATGCTCCAGTTGCTGTCAAGTTGA
GTAAGCAAGCTATAAATCGTGGTATGCAATGTGATATCGACACTGCATTGGCCTTCGAATCTGAA
GCATTTGGTGAATGCTTCTCAACAGAAGATCAAAAAGACGCAATGACCGCCTTTATCGAAAAGAG
AAAGATAGAAGGTTTCAAAAACAGAAAGTTATCTGGTGGTGGTGGTTCTGGTGGTGGTGGTTCT
GGTGGTGGTGGTAGTGCTGAAGCATGGTACAATTTGGGTAACGCTTACTACAAGCAGGGTGACT
ACCAAAAGGCAATCGAATACTACCAAAAGGCCTTGGAATTGGACCCAAATAACGCCGAAGCTTG
GTATAATTTGGGTAATGCCTATTATAAACAGGGTGACTATCAAAAAGCTATAGAATACTACCAAAA
GGCATTGGAATTGGACCCTAATAACGCAGAAGCCTGGTATAATTTGGGTAACGCCTATTATAAGC
AGGGTGACTATCAAAAGGCCATAGAAGACTACCAAAAGGCTTTGGAATTGGATCCAAACAACTTA
CAAGCTGAAGCATGGAAGAATTTGGGTAACGCTTATTACAAACAGGGTGACTACCAAAAAGCTAT
TGAATATTATCAAAAAGCTTTAGAATTAGACCCTAATAACGCCTCTGCTTGGTACAATTTGGGTAA
TGCCTACTATAAACAGGGTGACTACCAGAAGGCTATTGAATATTACCAAAAAGCTTTAGAATTGG
ATCCAAATAACGCAAAGGCCTGGTACAGACGTGGTAATGCCTATTACAAGCAGGGTGACTACCA
GAAAGCCATTGAAGATTATCAAAAAGCTTTGGAATTGGATCCTAACAACAGATCCAGAAGTGCTG
GTGGTGGTGGTTCTGGTGGTGGTGGTTCTGGTGGTGGTGGTGCTTCTGGTCCATTGGGTTCCC
CTTTGACTGCATCAATGTTAGCTTCCGCACCACCTCAAGAACAAAAGCAAATGTTGGGTGAAAGA
TTATTCCCATTGATACAAGCTATGCATCCTACTTTAGCAGGTAAAATCACAGGCATGTTGTTGGAA
ATCGATAACTCTGAATTGTTACACATGTTAGAATCCCCAGAAAGTTTGAGATCTAAAGTTGACGAA
GCCGTAGCTGTTTTGCAAGCTCATCAAGCAAAAGAAGCCGCTCAAAAGGCCGGTTCAGCTGGTT
CCGCAGCCGGTAGTGGTGAATTTGGTTCTGCTGAAGCTGCAGCCAAAGAAGCTGCAGCCAAGG
CAGGTAGTGCCGGTTCTGCTGCAGGTTCTGGTGAATTCGGTTCCAATACCAACATGAGTGTCCC
AACTGATGGTGCTGTAACTACATCTCAAATTCCTGCATCAGAACAAGAAACTTTAGTTAGACCAAA
GCCTTTGTTGTTGAAGTTGTTGAAGTCAGTAGGTGCTCAAAAAGATACCTACACTATGAAGGAAG
TTTTATTTTATTTGGGTCAATACATCATGACAAAGAGATTATACGATGAAAAGCAACAACATATCG
TTTACTGTTCAAACGATTTGTTGGGTGACTTGTTTGGTGTACCATCTTTCTCAGTTAAGGAACACA
GAAAGATCTATACAATGATATACAGAAATTTGGTCGTAGGTTCTGGTGCTACTAACTTCTCTTTGT
TGAAGCAAGCAGGTGACGTTGAAGAAAATCCAGGTCCAATGATCGTAAAGCCAATGGTTAGAAA
CAACATCTGTTTGAACGCTCATCCTCAAGGTTGCAAAAAGGGTGTAGAAGATCAAATCGAATACA
CCAAAAAGAGAATCACTGCAGAAGTTAAAGCCGGTGCTAAAGCACCTAAGAATGTTTTGGTCTTA
GGTTGTTCCAACGGTTATGGTTTGGCTAGTAGAATAACAGCTGCATTTGGTTACGGTGCCGCTAC
CATCGGTGTTTCCTTCGAAAAGGCTGGTAGTGAAACCAAATATGGTACTCCAGGTTGGTACAATA
ACTTGGCATTTGATGAAGCAGCCAAGAGAGAAGGTTTATACTCTGTCACTATAGATGGTGACGCT
TTCTCAGATGAAATCAAGGCACAAGTTATTGAAGAAGCCAAAAAGAAAGGTATAAAATTCGATTT
GATCGTTTACTCCTTAGCAAGTCCAGTCAGAACAGATCCTGACACCGGTATAATGCATAAGTCTG
TTTTGAAGCCATTCGGTAAAACTTTCACAGGTAAAACAGTCGATCCTTTCACCGGTGAATTGAAA
GAAATATCTGCTGAACCAGCAAATGATGAAGAAGCTGCAGCCACAGTAAAAGTTATGGGTGGTG
AAGACTGGGAAAGATGGATCAAGCAATTGTCCAAAGAAGGTTTGTTGGAAGAAGGTTGTATCAC
CTTAGCTTATTCATACATTGGTCCTGAAGCCACTCAAGCTTTGTATAGAAAGGTACAATCGGTAA
AGCTAAAGAACATTTGGAAGCCACCGCTCACAGATTAAATAAGGAAAACCCATCTATCAGAGCAT
```

Figure 15A (continued)

```
TTGTTTCTGTAAATAAGGGTTTAGTTACTAGAGCATCCGCCGTTATCCCAGTCATTCCTTTGTATT
TGGCTAGTTTGTTTAAGGTTATGAAGGAAAAGGGTAACCATGAAGGTTGCATAGAACAAATCACT
AGATTGTACGCAGAAAGATTATACAGAAAGGATGGTACAATTCCAGTTGACGAAGAAAACAGAAT
CAGAATCGATGACTGGGAATTGGAAGAAGATGTCCAAAAGGCAGTATCTGCCTTAATGGAAAAA
GTTACCGGTGAAAACGCTGAATCATTGACTGATTTGGCAGGTTATAGACACGACTTTTTAGCCTC
TAATGGTTTCGATGTCGAAGGTATTAACTACGAAGCAGAAGTAGAAAGATTCGACAGAATTAAAT
TGTCTGGTGGTGGTGGTTCTGGTGGTGGTGGTTCTGGTGGTGGTGGTAGTGCTGAAGCATGGT
ATAATTTGGGTAACGCTTATTACAAGCAGGGTGACTACCAAAAGGCCATCGAATACTACCAAAAG
GCTTTGGAATTGGACCCTAATAACGCCGAAGCTTGGTACAATTTGGGTAATGCCTACTATAAACA
GGGTGACTATCAAAAAGCAATTGAATATTACCAAAAGGCCTTGGAATTAGACCCAAATAACGCAG
AAGCCTGGTACAATTTGGGTAACGCCTACTATAAGCAGGGTGACTATCAAAGGCTATTGAAGAC
TACCAAAAGGCATTGGAATTAGATCCTAATAACTTGCAAGCTGAAGCATGGAAAAATTTGGGTAA
TGCCTATTATAAACAGGGTGACTACCAAAAAGCTATTGAATACTATCAAAAAGCTTTGGAATTGGA
CCCAAATAACGCCTCAGCTTGGTATAATTTGGGTAATGCATACTACAAACAGGGTGACTATCAGA
AGGCAATAGAATACTATCAAAAAGCCTTAGAATTGGATCCTAATAACGCAAAAGCCTGGTATAGA
CGTGGTAATGCCTACTACAAGCAGGGTGACTATCAGAAGGCGATAGAAGATTATCAAAAGGCAT
TGGAATTGGATCCAAACAACAGATCTAGATCAGCTGGTGGTGGTGGTTCTGGTGGTGGTGGTTC
TGGTGGTGGTGGTGCTTCTTCATATTACCATCACCATCACCATCACTTGGAATCCACAAGTTTATA
TAAGAAAGCAGGTTCTGGTTCAAATTTGTTAGCCACTTTGAGATCAACAGCTGCAGTATTGGAAA
ACGAAAACCATGTTTTGGAAAAAGAAAAGGAAAAGTTGAGAAAGGAAAAGGAACAATTGTTGAAT
AAGTTGGAAGCCTACAAAGGTTCTGCTGGTTCAGCCGCTGGTTCCGGTGAATTCGGTAGTGCTG
AAGCAGCCGCTAAGGAAGCAGCCGCTAAAGCTGGTTCCGCAGGTAGTGCAGCCGGTTCTGGTG
AATTTGGTTCCAGTTACTATCACCATCACCATCATCACTTGGAATCCACAAGTTTATATAAGAAAG
CTGGTTCTGGTTCAAAGAGAATCGCATACTTGAGAAAGAAAATCGCTGCATTAAAGAAAGATAAC
GCCAACTTGGAAAAGGACATCGCTAATTTGGAAAACGAAATCGAAAGATTGATTAAAGAAATTAA
AACATTAGAAAATGAAGTTGCTTCTCATGAACAAGGTTCAGGTGCTACTAACTTCTCTTTGTTGAA
GCAAGCAGGTGACGTTGAAGAAAATCCAGGTCCAATGACTAGAGAAGTTGTCGTAGTTAGTGGT
GTTAGAACAGCTATTGGTACCTTTGGTGGTTCTTTAAAAGATGTTGCACCAGCCGAATTGGGTGC
ATTAGTCGTAAGAGAAGCTTTGGCAAGAGCCCAAGTTTCAGGTGACGATGTCGGTCATGTTGTC
TTCGGTAACGTTATCCAAACAGAACCAAGAGATATGTATTTGGGTAGAGTAGCTGCAGTTAATGG
TGGTGTTACCATAAACGCTCCTGCATTAACTGTCAACAGATTGTGTGGTAGTGGTTTACAAGCTA
TTGTTTCTGCCGCTCAAACAATATTGTTAGGTGACACCGACGTTGCTATCGGTGGTGGTGCTGAA
TCTATGTCAAGAGCCCCATACTTAGCTCCTGCAGCCAGATGGGGTGCCAGAATGGGTGACGCTG
GTTTGGTTGACATGATGTTGGGTGCTTTGCATGATCCATTCCATAGAATCCACATGGGTGTAACT
GCAGAAAACGTTGCCAAGGAATACGATATCTCAAGAGCACAACAAGACGAAGCTGCATTAGAAT
CACACAGAAGAGCATCCGCCGCTATTAAAGCCGGTTACTTTAAGGATCAAATAGTTCCAGTAGTT
TCTAAAGGTAGAAAGGGTGACGTTACCTTCGATACTGACGAACATGTTAGACACGACGCTACTAT
TGATGACATGACAAAGTTAAGACCTGTTTTCGTCAAGGAAATGGTACTGTTACAGCTGGTAATG
CATCTGGTTTGAACGATGCAGCCGCTGCAGTCGTAATGATGGAAAGAGCCGAAGCTGAAAGAAG
AGGTTTGAAACCATTAGCTAGATTGGTTTCTTATGGTCATGCTGGTGTCGATCCTAAAGCAATGG
GTATAGGTCCAGTTCCTGCTACTAAGATCGCATTGGAAAGAGCCGGTTTACAAGTCTCTGATTTG
GACGTAATTGAAGCCAATGAAGCTTTTGCCGCTCAAGCATGTGCCGTTACAAAAGCCTTGGGTTT
AGATCCAGCTAAGGTCAATCCTAACGGTAGTGGTATCTCTTTAGGTCATCCAATTGGTGCAACCG
GTGCCTTGATAACTGTTAAGGCTTTGCACGAATTGAACAGAGTACAAGGTAGATATGCATTAGTT
ACAATGTGCATCGGTGGTGGTCAAGGTATTGCAGCCATATTCGAAAGAATTAAGTTGTCTGGTG
GTGGTGGTTCTGGTGGTGGTGGTTCTGGTGGTGGTGGTAGTGCTGAAGCATGGTACAATTTGG
GTAACGCTTACTACAAGCAGGGTGACTACCAAAAGGCAATCGAATATTACCAAAAGCCTTGGAA
TTAGACCCAAATAACGCCGAAGCTTGGTATAATTTGGGTAATGCCTATTATAAACAGGGTGACTA
TCAAAAAGCTATAGAATACTACCAAAAGGCATTGGAATTAGACCCTAATAACGCAGAAGCCTGGT
```

Figure 15A (continued)

ATAATTTGGGTAACGCCTATTATAAGCAGGGTGACTATCAAAAGGCCATAGAAGACTACCAAAAG
GCTTTGGAATTGGATCCAAACAACTTACAAGCTGAAGCATGGAAGAATTTGGGTAACGCTTATTA
CAAACAGGGTGACTACCAAAAAGCTATTGAATACTATCAAAAGGCTTTAGAATTGGACCCTAATA
ACGCCTCTGCTTGGTACAATTTGGGTAATGCCTACTATAAACAGGGTGACTACCAGAAGGCTATC
GAATATTATCAAAAAGCTTTAGAATTGGACCCAAATAACGCAAAGGCCTGGTACAGACGTGGTAA
TGCCTATTACAAGCAGGGTGACTACCAGAAAGCTATTGAAGATTATCAAAAGGCATTGGAATTGG
ATCCTAACAACAGATCCAGAAGTGCTGGTGGTGGTGGTTCTGGTGGTGGTGGTTCTGGTGGTGG
TGGTGCTTCTGATGTTATGTGGGAATATAAGTGGGAAAATACAGGTGACGCTGAATTATACGGTC
CTTTTACTTCAGCACAAATGCAAACATGGGTATCCGAAGGTTATTTCCCTGATGGTGTTTACTGCA
GAAAATTAGACCCACCTGGTGGTCAATTCTACAACTCAAAGAGAATAGATTTCGACTTGTACACC
GGTTCAGCTGGTTCCGCTGCAGGTTCTGGTGAATTTGGTTCCGCAGAAGCCGCTGCAAAAGAAG
CCGCTGCAAAGGCTGGTAGTGCAGGTTCTGCCGCTGGTAGTGGTGAATTTGGTTCTGAATCAGA
TTCCGTCGAATTCAATAACGCTATATCTTACGTAAATAAGATTAAAACCAGATTTTTAGATCATCCA
GAAATCTATAGATCATTCTTAGAAATCTTGCATACATACCAAAAAGAACAATTGCACACCAAGGGT
AGACCTTTCAGAGGCATGTCCGAAGAAGAAGTCTTTACTGAAGTAGCTAATTTGTTTAGAGGTCA
AGAAGATTTGTTGTCAGAATTCGGTCAATTCTTGCCAGAAGCAAAAAGAGGTTCCGGTGCTACTA
ACTTCTCTTTGTTGAAGCAAGCAGGTGACGTTGAAGAAATCCAGGTCCAATGGGTAAAATTAC
AAGTCATTGGATTCCGTTGTCGCAAGTGACTTTATTGCCTTGGGTATAACTTCTGAAGTCGCAGA
AACATTGCATGGTAGATTAGCCGAAATTGTATGTAACTACGGTGCTGCAACCCCACAAACTTGGA
TCAACATAGCAAACCATATCTTGTCACCAGATTTGCCTTTCTCCTTGCACCAAATGTTGTTTTATG
GTTGCTACAAGGATTTCGGTCCTGCTCCACCTGCATGGATTCCAGACCCTGAAAAGGTTAAGTC
AACTAATTTGGGTGCTTTGTTAGAAAAGAGAGGTAAAGAATTCTTGGGTGTTAAGTACAAGGATC
CAATCTCTTCTTTTTCTCACTTCCAAGAATTTTCTGTCAGAAACCCTGAAGTATACTGGAGAACAG
TTTTGATGGATGAAATGAAAATAAGTTTCTCTAAGGACCCAGAATGTATCTTGAGAAGAGATGAC
ATCAACAACCCAGGTGGTTCTGAATGGTTGCCAGGTGGTTATTTGAACTCAGCTAAAAATTGCTT
GAACGTTAACTCCAATAAGAAATTGAATGATACTATGATTGTCTGGAGAGATGAAGGCAACGATG
ACTTGCCATTGAATAAGTTGACATTGGATCAATTGAGAAAGAGAGTTTGGTTGGTCGGTTACGCA
TTAGAAGAAATGGGTTTGGAAAAAGGTTGTGCCATAGCTATCGATATGCCTATGCATGTAGACGC
TGTAGTTATCTATTTGGCTATTGTTTAGCAGGTTACGTCGTAGTTTCTATAGCTGATTCATTTTCC
GCACCAGAAATCTCAACTAGATTGAGATTATCCAAAGCAAAGGCCATATTCACACAAGATCACAT
CATCAGAGGTAAAAAGAGAATCCCTTTATACTCAAGAGTCGTAGAAGCCAAATCCCCAATGGCTA
TAGTTATCCCTTGTAGTGGTTCTAACATTGGTGCAGAATTAAGAGATGGTGACATATCTTGGGATT
ACTTTTTGGAAAGAGCCAAAGAATTCAAGAATTGCGAATTCACTGCCAGAGAACAACCAGTTGAT
GCTTACACTAACATTTTGTTCTCCAGTGGTACTACAGGTGAACCAAAAGCAATACCTTGGACACA
AGCCACCCCTTTAAAGGCCGCTGCAGATGGTTGGTCACATTTGGATATTAGAAAGGTGACGTC
ATAGTATGGCCAACTAATTTGGGTTGGATGATGGGTCCTTGGTTGGTTTATGCTAGTTTGTTAAAT
GGTGCCTCTATTGCTTTATACAACGGTAGTCCATTGGTTTCTGGTTTCGCTAAATTTGTCCAAGAT
GCAAAGTAACAATGTTGGGTGTTGTCCCTTCAATCGTTAGAAGTTGGAAGTCTACAAATTGTGT
CTCAGGTTATGATTGGTCCACCATCAGATGCTTTTCTTCATCCGGTGAAGCCTCTAATGTCGACG
AATATTTGTGGTTAATGGGTAGAGCTAACTACAAGCCAGTTATCGAAATGTGTGGTGGTACCGAA
ATTGGTGGTGCATTCTCAGCCGGTTCCTTTTACAAGCTCAATCATTGAGTTCTTTTTCATCCCAA
TGTATGGGTTGCACATTGTACATCTTGGATAAGAACGGTTACCCAATGCCTAAAAATAAGCCAGG
TATTGGTGAATTGGCTTTAGGTCCTGTTATGTTCGGTGCATCTAAAACATTGTTGAACGGTAACCA
TCACGATGTATACTTCAAGGGTATGCCAACCTTAAATGGTGAAGTTTTGAGAAGACATGGTGACA
TATTCGAATTAACCTCAAACGGTTACTACCATGCCCACGGTAGAGCTGATGACACTATGAACATC
GGTGGTATCAAAATCAGTTCTATCGAAATCGAAAGAGTATGTAACGAAGTTGATGACAGAGTCTT
TGAAACCACTGCAATTGGTGTTCCACCATTGGGTGGTGGTCCAGAACAATTAGTAATCTTTTCG
TTTTGAAGGATTCTAACGACACAACCATAGATTTGAACCAATTGAGATTATCTTTTAACTTGGGTT

Figure 15A (continued)

TACAAAAGAAATTGAACCCATTATTCAAAGTTACTAGAGTAGTTCCATTGTCATCCTTACCTAGAA
CTGCTACAAACAAGATTATGAGAAGAGTCTTGAGACAACAATTCAGTCATTTTGAAGGTTCTGGT

Figure 15B

Complete GPP Gene Cassette Nucleotide Sequence

ATGAAGTTATCTACTAAATTGTGTTGGTGCGGTATTAAGGGTAGATTAAGACCACAAAAGCAACA
ACAATTGCATAACACAAACTTGCAAATGACCGAATTGAAGAAACAAAAGACTGCTGAACAAAAGA
CTAGACCACAAAACGTTGGTATTAAAGGTATCCAAATCTATATCCCTACACAATGTGTCAATCAAT
CTGAATTGGAAAAGTTTGATGGTGTATCACAGGGTAAATACACTATCGGTTTAGGTCAAACAAAC
ATGTCTTTCGTAAACGATAGAGAAGACATCTATTCTATGTCATTGACTGTTTTGTCCAAGTTGATA
AAAAGTTACAACATCGATACAAACAAGATTGGTAGATTGGAAGTTGGTACCGAAACTTTGATCGA
TAAGTCCAAGAGTGTCAAGTCTGTATTGATGCAATTGTTCGGTGAAAATACCGATGTTGAAGGTA
TCGACACTTTAAATGCTTGTTATGGTGGTACTAACGCATTATTCAATTCATTGAACTGGATCGAAT
CCAATGCCTGGGATGGTAGAGATGCTATTGTTGTCTGCGGTGACATCGCTATCTATGACAAAGG
TGCTGCAAGACCAACCGGTGGTGCAGGTACTGTTGCCATGTGGATAGGTCCAGATGCACCTATC
GTTTTTGACTCTGTCAGAGCATCATACATGGAACATGCCTACGATTTCTACAAACCAGACTTCAC
CTCCGAATATCCTTACGTTGATGGTCACTTTTCTTTGACTTGTTACGTCAAGGCTTTGGACCAAGT
ATACAAGTCTTACTCTAAGAAAGCAATATCTAAGGGTTTGGTTTCAGATCCAGCTGGTTCCGACG
CATTAAACGTCTTGAAGTACTTCGATTACAACGTTTTCCATGTCCCTACATGCAAGTTGGTTACCA
AGTCTTACGGTAGATTGTTGTACAACGATTTCAGAGCTAACCCACAATTGTTCCCTGAAGTCGAC
GCTGAATTAGCAACTAGAGATTACGACGAATCTTTGACAGATAAGAACATCGAAAAGACTTTCGT
AAACGTTGCAAAGCCATTCCACAAAGAAAGAGTTGCCCAATCATTAATTGTCCCTACAAATACCG
GTAACATGTATACAGCCTCAGTTTACGCCGCTTTTGCTTCCTTGTTAAATTATGTAGGTAGTGATG
ACTTGCAAGGTAAAAGAGTTGGTTTATTCTCCTATGGTAGTGGTTTAGCAGCCTCTTTGTACTCTT
GTAAGATTGTAGGTGACGTTCAACACATTATTAAGGAATTGGACATCACTAATAAGTTGGCTAAG
AGAATCACTGAAACACCAAAGGATTATGAAGCTGCAATCGAATTGAGAGAAAACGCACATTTGAA
GAAAAATTTCAAACCTCAAGGTAGTATAGAACACTTGCAATCTGGTGTCTACTACTTAACAAACAT
CGATGACAAATTCAGAAGATCATACGATGTTAAAAAGAAATTGTCTGGTGGTGGTGGTTCTGGTG
GTGGTGGTTCTGGTGGTGGTGGTAGTGCTGAAGCATGGTATAATTTGGGTAACGCTTATTACAA
GCAGGGTGACTACCAAAAAGCAATCGAATATTACCAAAAGGCCTTGGAATTAGACCCAAATAACG
CCGAAGCTTGGTACAATTTGGGTAATGCATACTATAAACAGGGTGACTATCAAAAGGCTATCGAA
TACTACCAAAAGGCATTGGAATTAGACCCTAATAACGCAGAAGCCTGGTACAATTTGGGTAACGC
CTACTATAAGCAGGGTGACTATCAAAAAGCCATAGAAGACTACCAAAAGGCTTTGGAATTAGATC
CAAATAACTTGCAAGCTGAAGCATGGAAAAATTTGGGTAATGCCTACTACAAACAGGGTGACTAC
CAAAAGGCAATTGAATATTATCAAAAAGCCTTGGAATTAGATCCTAATAACGCCTCAGCTTGGTAT
AATTTGGGTAATGCCTATTATAAGCAGGGTGACTACCAGAAAGCCATTGAATATTATCAAAAGGC
TTTAGAATTGGATCCAAATAACGCAAAAGCCTGGTATAGACGTGGTAATGCCTACTACAAGCAGG
GTGACTATCAGAAGGCTATTGAAGATTATCAAAAAGCTTTGGAATTGGATCCAAACAACAGATCC
AGAAGTGCTGGTGGTGGTGGTTCTGGTGGTGGTGGTTCTGGTGGTGGTGGTGCTTCTTTGGGT
CCTTTGCCACCTGGTTGGGAAGTAAGATCCACAGTTAGTGGTAGAATCTATTTCGTTGATCATAA
CAACAGAACTACACAATTCACCGACCCAAGATTGCACGGTTCTGCTGGTTCAGCCGCTGGTTCT
GGTGAATTTGGTTCCGCAGAAGCAGCCGCTAAGGAAGCAGCCGCTAAAGCCGGTTCCGCTGGT
AGTGCAGCCGGTAGTGGTGAATTTGGTTCTGGTGCTATGGGTCCATTACCACCTGGTTGGGAAA
AGAGAACAGATTCTAACGGTAGAGTCTACTTCGTAAACCATAATACCAGAATTACTCAATGGGAA
GATCCTAGATCTGGTTCAGGTGCTACTAACTTCTCTTTGTTGAAGCAAGCAGGTGACGTTGAAGA
AAATCCAGGTCCAATGGTAGCCGTTAGAAGAAAGGCTTTGTCTATCTTAGCCGAAGCTCCAGTTT
TGGCATCAGATAGATTACCTTACAAGAACTACGATTACGACAGAGTATTTGGTGCTTGTTGCGAA

Figure 15B (continued)

```
AACGTTATTGGTTATATGCCATTGCCTGTCGGTGTAATCGGTCCATTAGTTATTGATGGTACATCT
TACCATATCCCTATGGCAACTACAGAAGGTTGTTTGGTTGCATCAGCCATGAGAGGTTGCAAGG
CAATTAATGCTGGTGGTGGTGCTACCACTGTTTTAACCAAAGATGGTATGACTAGAGGTCCAGTT
GTCAGATTTCCTACTTTGAAGAGATCCGGTGCTTGTAAAATATGGTTAGATAGTGAAGAAGGTCA
AAATGCCATCAAAAAGGCTTTTAACTCCACAAGTAGATTCGCAAGATTGCAACATATTCAAACATG
CTTAGCCGGTGACTTGTTGTTTATGAGATTCAGAACAACCACTGGTGACGCTATGGGTATGAATA
TGATATCTAAGGGTGTCGAATACTCATTGAAGCAAATGGTAGAAGAATACGGTTGGGAAGATATG
GAAGTAGTTTCTGTTTCAGGCAACTACTGTACTGACAAAAAGCCAGCTGCAATTAACTGGATAGA
AGGTCGTGGTAAATCTGTCGTAGCTGAAGCAACAATACCTGGTGACGTTGTTAGAAAGGTTTTGA
AATCTGACGTATCAGCTTTGGTTGAATTGAACATCGCTAAAATTTGGTTGGTTCCGCCATGGCT
GGTAGTGTCGGTGGTTTTAATGCACATGCCGCTAACTTAGTTACAGCAGTCTTCTTGGCCTTAGG
TCAAGATCCAGCTCAAAACGTAGAATCTTCAAACTGTATCACCTTGATGAAGAAGTTGATGGTG
ACTTAAGAATATCCGTTAGTATGCCATCAATAGAAGTCGGTACAATCGGTGGTGGTACCGTCTTG
GAACCTCAAGGTGCAATGTTAGATTTGTTAGGTGTTAGAGGTCCACATGCAACTGCCCCTGGTA
CAAATGCTAGACAATTGGCAAGAATTGTCGCTTGTGCAGTATTAGCTGGTGAATTGTCCTTATGC
GCAGCCTTGGCTGCAGGTCACTTAGTTCAAAGTCATATGACACACAACAGAAAGTTGTCTGGTG
GTGGTGGTTCTGGTGGTGGTGGTTCTGGTGGTGGTGGTAGTGCCGAAGCTTGGTATAATTTGGG
TAACGCATATTACAAGCAGGGTGACTACCAAAAGGCCATCGAATACTACCAAAAGGCTTTGGAAT
TGGACCCAAATAACGCAGAAGCCTGGTACAATTTGGGTAATGCTTACTATAAACAGGGTGACTAT
CAAAAGGCAATTGAATATTACCAAAAGGCCTTGGAATTAGACCCTAATAACGCTGAAGCATGGTA
CAATTTGGGTAACGCCTACTATAAGCAGGGTGACTATCAAAAAGCTATTGAAGACTACCAAAAGG
CATTGGAATTAGATCCAAATAACTTGCAAGCCGAAGCTTGGAAAAATTTGGGTAACGCTTACTAC
AAACAGGGTGACTACCAAAAAGCTATTGAATACTATCAAAAAGCTTTGGAATTGGACCCTAATAA
CGCATCTGCCTGGTATAATTTGGGTAATGCTTATTATAAACAGGGTGACTACCAGAAGGCAATAG
AATACTATCAAAAAGCCTTGGAATTAGACCCAAATAACGCTAAAGCATGGTATAGACGTGGTAAT
GCTTACTATAAGCAGGGTGACTACCAGAAAGCTATAGAAGATTATCAAAAGGCATTGGAATTGGA
TCCTAACAACAGATCTAGATCAGCTGGTGGTGGTGGTTCTGGTGGTGGTGGTTCTGGTGGTGGT
GGTGCTTCCAGTTATTACCATCACCATCACCATCACTTGGAATCCACAAGTTTATACAAAAGGC
AGGTTCAGAATTTTTCAGAAGAGAAAGAAATAAGATGGCCGCTGCAAAATGTAGAAACAGAAGAA
GAGAATTGACAGATACCTTACAAGCTGAAACCGATCAATTGGAAGACGAAAAGTCTGCATTGCAA
ACTGAAATAGCCAATTTGTTGAAGGAAAAGGAAAAGTTGGAATTCATTTTAGCCGCTCATAGACC
AGCTTGCAAAATTCCTGATGACTTGGGTTTCCCAGAAGAAATGTCTTTAGAAGGTTCCGCAGGTA
GTGCAGCCGGTTCCGGTGAATTTGGTAGTGCTGAAGCTGCAGCCAAGGAAGCTGCAGCCAAAG
CTGGTTCTGCAGGTTCAGCTGCAGGTTCCGGTGAATTCGGTTCTTCATACTATCACCATCACCAT
CATCACTTGGAATCTACCTCATTATACAAAAGGCTGGTTCCGGTAGTCAAAAGGTTGAATCTTT
GAAGCAAAAGATTGAAGAATTGAAGCAAAGAAAAGCCCAATTGAAGAATGATATCGCTAACTTAG
AAAAGGAAATCGCCTACGCTGAAACTGGTTCTGGTGCTACTAACTTCTCTTTGTTGAAGCAAGCA
GGTGACGTTGAAGAAATCCAGGTCCAATGAGTTTACCATTTTTGACATCTGCTCCTGGTAAAGT
TATTATATTCGGTGAACATAGTGCCGTCTATAATAAGCCAGCTGTCGCTGCATCTGTATCAGCTTT
GAGAACATACTTGTTGATCTCTGAATCTTCAGCACCTGATACCATCGAATTGGATTTCCCAGACA
TCTCATTCAATCACAAGTGGTCCATTAATGATTTCAACGCTATCACCGAAGACCAAGTAAACTCAC
AAAAGTTGGCCAAAGCTCAACAAGCAACTGATGGTTTGTCACAAGAATTAGTTTCCTTGTTAGAC
CCATTGTTGGCTCAATTGTCCGAAAGTTTCCATTACCACGCCGCTTTCTGTTTCTTGTACATGTTC
GTTTGTTTATGCCCTCATGCTAAGAATATCAAATTTTCTTTGAAGTCTACTTTGCCAATTGGTGCA
GGTTTAGGTTCCAGTGCCTCTATATCAGTTTCCTTAGCATTGGCCATGGCTTATTTGGGTGGTTT
GATAGGTAGTAACGATTTGGAAAAGTTGTCTGAAAACGACAAGCATATCGTCAACCAATGGGCAT
TCATCGGTGAAAATGCATTCACGGTACTCCTAGTGGTATAGATAATGCAGTTGCCACATATGGT
AACGCTTTGTTATTCGAAAAGGACTCTCATAACGGTACCATCAACACTAACAACTTCAAGTTCTTG
GATGACTTTCCTGCAATACCAATGATCTTGACTTACACAAGAATTCCAAGATCTACTAAAGATTTG
```

Figure 15B (continued)

```
GTAGCTAGAGTCAGAGTATTGGTTACAGAAAAGTTCCCTGAAGTTATGAAGCCAATCTTGGATGC
AATGGGTGAATGTGCCTTGCAAGGTTTGGAAATCATGACAAAGTTGTCAAAGTGCAAGGGTACT
GATGACGAAGCTGTTGAAACAAATAACGAATTGTACGAACAATTGTTGGAATTGATCAGAATCAA
TCATGGTTTGTTAGTTTCAATTGGTGTCTCCCACCCAGGTTTAGAATTGATAAAGAACTTGTCAGA
TGACTTAAGAATCGGTTCCACAAAATTGACCGGTGCTGGTGGTGGTGGTTGTTCTTTGACCTTGT
TAAGAAGAGATATCACTCAAGAACAAATCGACAGTTTTAAAAAGAAATTGCAAGATGACTTCTCTT
ACGAAACTTTCGAAACAGATTTGGGTGGTACTGGTTGTTGCTTGTTGTCAGCTAAGAATTTGAAC
AAAGATTTGAAGATTAAATCCTTGGTTTTCCAATTGTTCGAAAATAAGACTACAACCAAGCAACAA
ATCGATGACTTGTTGTTGCCTGGTAATACAAACTTGCCATGGACCTCAAAATTATCTGGTGGTGG
TGGTTCTGGTGGTGGTGGTTCTGGTGGTGGTGGTAGTGCTGAAGCATGGTATAATTTGGGTAAC
GCATATTACAAGCAGGGTGACTACCAAAAGGCTATCGAATACTACCAAAAGGCATTGGAATTGGA
CCCTAATAACGCCGAAGCTTGGTACAATTTGGGTAATGCTTACTATAAACAGGGTGACTATCAAA
AGGCCATTGAATATTACCAAAAGGCTTTGGAATTGGACCCAAATAACGCAGAAGCCTGGTACAAT
TTGGGTAACGCTTACTATAAGCAGGGTGACTATCAAAAAGCAATTGAAGACTACCAAAAGGCCTT
AGAATTGGATCCTAATAACTTGCAAGCTGAAGCATGGAAAAATTTGGGTAACGCTTATTATAAACA
GGGTGACTACCAAAAGCCATTGAATACTATCAAAAAGCATTGGAATTGGATCCAAATAACGCCT
CTGCTTGGTATAATTTGGGTAATGCTTATTATAAGCAGGGTGACTACCAGAAAGCCATAGAATAC
TATCAAAAAGCTTTGGAATTAGACCCTAATAACGCAAAAGCCTGGTATAGACGTGGTAATGCTTA
CTACAAACAGGGTGACTATCAGAAGGCAATAGAAGATTATCAAAAAGCTTTAGAATTAGACCCAA
ATAACAGAAGTAGATCTGCTGGTGGTGGTGGTTCTGGTGGTGGTGGTTCTGGTGGTGGTGGTG
CTTCTATGGAACCTGCAATGGAACCAGAAACATTGGAAGCCAGAATCAATAGAGCTACCAATCCT
TTGAACAAGGAATTGGATTGGGCTTCTATTAATGGTTTCTGTGAACAATTGAACGAAGACTTCGA
AGGTCCACCTTTAGCAACAAGATTATTGGCCCATAAAATTCAATCACCACAAGAATGGGAAGCAA
TACAAGCCTTAACCGTCTTGGAAACTTGTATGAAGTCCTGCGGTAAAGATTCCACGATGAAGTT
GGTAAATTCAGATTTTTGAACGAATTGATCAAGGTTGTCTCACCTAAGTATTTGGGTAGTAGAACA
TCTGAAAAGGTTAAAAACAAGATCTTGGAATTGTTGTACTCCTGGACCGTAGGTTACCAGAAGA
AGTTAAGATCGCTGAAGCATACCAAATGTTGAAGAAACAAGGTATTGTTAAGTCAGGTTCCGCCG
GTAGTGCAGCCGGTTCTGGTGAATTCGGTTCTGCAGAAGCTGCAGCCAAGGAAGCTGCAGCCA
AAGCTGGTTCAGCAGGTTCCGCTGCAGGTTCTGGTGAATTTGGTTCAGGTGCAATGGGTTCCAT
GGCCGAAGCTGAAGGTGAAAGTTTGGAATCTTGGTTAAATAAGGCTACAAATCCATCAAACAGAC
AAGAAGATTGGGAATATATCATTGGTTTCTGTGACCAAATCAATAAGGAATTGGAAGGTCCTCAA
ATAGCTGTTAGATTATTGGCACATAAGATCCAATCTCCACAAGAATGGGAAGCCTTACAAGCTTT
GACTGTTTTAGAAGCTTGTATGAAGAATTGCGGTAGAAGATTTCACAACGAAGTCGGTAAATTCA
GATTTTTGAATGAATTAATTAAGGTAGTTAGTCCAAAATACTTAGGTGACAGAGTTTCTGAAAAGG
TTAAGACCAAAGTCATAGAATTGTTGTACTCTTGGACTATGGCCTTGCCTGAAGAAGCTAAGATC
AAAGATGCATACCATATGTTGAAGAGACAAGGTATAGTCCAATCAGATCCACCTATCCCAGTAGA
CAGAACTTTGATTCCATCTCCACCACCAAGACCTAAAAATGGTTCCGGTGCTACTAACTTCTCTTT
GTTGAAGCAAGCAGGTGACGTTGAAGAAAATCCAGGTCCAATGTCCGAATTAAGAGCTTTTAGT
GCACCTGGTAAAGCCTTGTTAGCTGGTGGTTATTTGGTTTTGGATACAAAGTACGAAGCATTCGT
TGTCGGTTTGTCAGCCAGAATGCATGCAGTCGCCCACCCTTACGGTTCTTTACAAGGTTCTGATA
AGTTCGAAGTAAGAGTCAAGTCTAAGCAATTCAAGGACGGTGAATGGTTATACCATATATCTCCA
AAGTCAGGTTTTATTCCTGTTTCCATAGGTGGTAGTAAAAATCCATTCATCGAAAAGGTTATTGCA
AACGTCTTTTCTTACTTCAAGCCTAACATGGATGACTACTGTAACAGAACTTGTTCGTCATCGAT
ATATTCTCTGATGACGCTTATCATTCTCAAGAAGACTCAGTAACTGAACACAGAGGTAATAGAAG
ATTGTCCTTTCATAGTCACAGAATTGAAGAAGTTCCAAAAACCGGTTTAGGTTCTTCAGCTGGTG
GTTTAGTCACTGTATTGACTACAGCTTTAGCATCCTTTTTCGTTAGTGATTTGGAAAACAACGTAG
ACAAGTACAGAGAAGTTATTCATAATTTGGCACAAGTAGCCCACTGCCAAGCACAAGGTAAAATC
GGTTCCGGTTTTGATGTTGCTGCAGCCGCTTATGGTTCAATTAGATACAGAAGATTCCCACCTGC
TTTGATATCTAATTTGCCAGATATCGGTTCTGCTACATATGGTTCAAAGTTGGCACATTTGGTTGA
```

Figure 15B (continued)

```
TGAAGAAGACTGGAACATCACAATTAAATCCAACCATTTGCCTAGTGGTTTGACCTTATGGATGG
GTGACATTAAGAATGGTTCTGAAACTGTTAAGTTGGTCCAAAAAGTAAAGAACTGGTACGATTCT
CATATGCCAGAATCATTGAAGATCTACACAGAATTAGACCATGCTAATTCCAGATTCATGGATGG
TTTGAGTAAATTAGACAGATTGCATACCCACGATGACTACTCTGATCAAATCTTCGAATCATTGGA
AAGAAACGACTGTACTTGCCAAAAATACCCAGAAATCACAGAAGTAAGAGATGCCGTTGCTACCA
TAAGAAGATCTTTTAGAAAGATCACTAAGGAATCAGGTGCAGATATCGAACCACCTGTTCAAACA
TCTTTGTTAGATGACTGTCAAACCTTGAAGGGTGTCTTAACTTGCTTGATTCCAGGTGCTGGTGG
TTATGATGCAATAGCCGTCATCACTAAACAAGATGTAGACTTGAGAGCTCAAACAGCAAACGATA
AGAGATTTTCAAAGGTCCAATGGTTAGATGTAACCCAAGCTGACTGGGGTGTTAGAAAAGAAAAG
GATCCTGAAACTTACTTGGACAAAAAGTTATCTGGTGGTGGTGGTTCTGGTGGTGGTGGTTCTG
GTGGTGGTGGTAGTGCTGAAGCATGGTACAATTTGGGTAACGCATACTACAAGCAGGGTGACTA
CCAAAAGGCCATAGAATACTACCAAAAGGCTTTGGAATTGGACCCAAATAACGCCGAAGCTTGG
TATAATTTGGGTAATGCTTATTATAAACAGGGTGACTATCAAAAGGCAATCGAATACTACCAAAAG
GCCTTGGAATTAGACCCTAATAACGCAGAAGCCTGGTATAATTTGGGTAACGCTTATTATAAGCA
GGGTGACTATCAAAAGCTATCGAAGACTACCAAAAGGCATTGGAATTAGATCCAAATAACTTGC
AAGCTGAAGCATGGAAGAATTTGGGTAACGCTTACTATAAACAGGGTGACTACCAAAAGCCATT
GAATATTATCAAAAGCTTTGGAATTGGATCCTAATAACGCCTCTGCTTGGTACAATTTGGGTAAT
GCTTACTATAAGCAGGGTGACTATCAGAAGGCTATTGAATATTATCAAAAGGCTTTAGAATTGGA
CCCTAATAACGCAAAGGCCTGGTACAGACGTGGTAACGCTTATTACAAACAGGGTGACTACCAG
AAAGCTATTGAAGATTATCAAAAGGCATTGGAATTGGATCCTAACAACAGATCCAGAAGTGCTGG
TGGTGGTGGTTCTGGTGGTGGTGGTTCTGGTGGTGGTGGTGCTTCCAGTTATTACCATCACCAT
CACCATCACTTGGAATCTACATCATTATACAAAAAGGCTGGTTCCGGTAGTCAAAAGGTTGAAGA
ATTGAAAAATAAGATAGCCGAATTGGAAAACAGAAACGCTGTTAAAAAGAACAGAGTCGCACATT
TGAAACAAGAAATAGCCTACTTGAAGGATGAATTAGCAGCCCATGAATTTGAAGGTTCTGCCGGT
TCAGCTGCAGGTTCTGGTGAATTCGGTTCAGCTGAAGCCGCTGCAAAAGAAGCCGCTGCAAAG
GCCGGTTCCGCTGGTAGTGCCGCTGGTTCTGGTGAATTTGGTTCTTCATACTATCACCATCACCA
TCATCACTTGGAATCTACTTCATTATATAAAAAGGCCGGTTCCGGTAGTTTCGAAAACGTTACACA
TGAATTCATTTTGGCTACCTTGGAAAACGAAAACGCAAAGTTAAGAAGATTGGAAGCCAAGTTGG
AAAGAGAATTAGCTAGATTGAGAAATGAAGTTGCATGGTTAGGTTCTGGTGCTACTAACTTCTCT
TTGTTGAAGCAAGCAGGTGACGTTGAAGAAAATCCAGGTCCAATGACAGTTTATACCGCTTCTGT
CACCGCACCTGTAAATATTGCTACTTTGAAATACTGGGGTAAAAGAGATACTAAGTTGAATTTGC
CAACAAACTCTTCAATCTCAGTTACATTGTCCCAAGATGACTTAAGAACCTTGACTTCTGCTGCAA
CTGCTCCTGAATTCGAAAGAGATACATTGTGGTTGAATGGTGAACCACATTCTATCGACAACGAA
AGAACTCAAAACTGTTTGAGAGATTTGAGACAATTGAGAAAGGAAATGGAGAGTAAGGATGCTTC
TTTGCCTACATTGAGTCAATGGAAGTTGCACATAGTTTCTGAAAACAACTTCCCAACCGCCGCTG
GTTTGGCATCCAGTGCAGCCGGTTTCGCTGCATTAGTCTCTGCAATCGCCAAGTTGTACCAATTG
CCACAAAGTACATCTGAAATCAGTAGAATCGCTAGAAAAGGTTCAGGTTCCGCATGTAGATCTTT
ATTTGGTGGTTACGTCGCATGGGAAATGGGTAAAGCCGAAGACGGTCATGATTCAATGGCCGTA
CAAATAGCTGACTCTTCAGATTGGCCTCAAATGAAAGCTTGCGTCTTGGTTGTCTCAGACATCAA
AAAGGATGTATCCAGTACACAAGGCATGCAATTGACTGTTGCAACATCCGAATTGTTTAAAGAAA
GAATCGAACACGTAGTTCCAAAAAGATTCGAAGTCATGAGAAAGGCTATCGTAGAAAAGGATTTC
GCCACCTTCGCTAAGGAAACTATGATGGACAGTAACTCTTCCATGCAACTTGTTTGGATTCATTT
CCACCTATTTTCTATATGAACGACACCTCAAAGAGAATAATCTCCTGGTGCCACACTATCAACCA
ATTCTACGGTGAAACAATCGTTGCTTACACCTTCGATGCAGGTCCTAATGCCGTCTTGTATTACTT
AGCCGAAAACGAATCAAAGTTGTTCGCTTTTATATATAAGTTGTTTGGTTCCGTTCCAGGTTGGG
ATAAAAAGTTCACTACAGAACAATTGGAAGCTTTTAATCATCAATTCGAATCTTCAAACTTTACTG
CCAGAGAATTGGACTTAGAATTGCAAAAGGATGTAGCTAGAGTTATCTTGACCCAAGTTGGTTCA
GGTCCTCAAGAAACTAACGAATCCTTGATAGATGCTAAGACAGGTTTGCCAAAAGAAAATTGTC
TGGTGGTGGTGGTTCTGGTGGTGGTGGTTCTGGTGGTGGTGGTAGTGCTGAAGCATGGTATAAT
```

Figure 15B (continued)

```
TTGGGTAACGCTTATTACAAGCAGGGTGACTACCAAAAGGCCATCGAATACTACCAAAAGGCTTT
GGAATTGGACCCTAATAACGCCGAAGCTTGGTACAATTTGGGTAATGCCTACTATAAACAGGGT
GACTATCAAAAAGCAATTGAATATTACCAAAAGGCCTTGGAATTGGACCCAAATAACGCAGAAGC
CTGGTACAATTTGGGTAACGCCTACTATAAGCAGGGTGACTATCAAAAGGCTATCGAAGATTACC
AAAAGGCATTAGAATTGGATCCTAATAACTTGCAAGCTGAAGCATGGAAAAATTTGGGTAATGCC
TATTATAAACAGGGTGACTACCAAAAAGCTATTGAATACTATCAAAAAGCTTTAGAATTAGACCCA
AATAACGCCTCAGCTTGGTATAATTTGGGTAATGCATACTACAAACAGGGTGACTATCAGAAGGC
AATTGAATACTATCAAAAGGCATTAGAATTAGATCCTAATAACGCAAAAGCCTGGTATAGACGTG
GTAATGCCTACTACAAGCAGGGTGACTATCAGAAGGCGATTGAAGACTACCAAAAGGCATTGGA
ATTGGATCCAAACAACAGATCAAGATCCGCTGGTGGTGGTGGTTCTGGTGGTGGTGGTTCTGGT
GGTGGTGGTGCTTCTGCAATGGCCGATTTGGAACAAAAGGTATTGGAAATGGAAGCTAGTACAT
ATGACGGTGTTTTTATTTGGAAGATCTCTGATTTCCCAAGAAAAAGACAAGAAGCTGTTGCAGGT
AGAATCCCTGCTATTTTTAGTCCAGCATTCTACACCTCTAGATACGGTTACAAGATGTGTTTGAGA
ATATATTTGAATGGTGACGGTACTGGTAGAGGTACTCATTTGTCTTTGTTTTTCGTCGTAATGAAG
GGTCCTAATGATGCTTTGTTGAGATGGCCTTTTAATCAAAAGGTTACCTTGATGTTGTTGGATCAA
AACAACAGAGAACACGTTATCGACGCTTTTAGACCTGATGTCACTTCCAGTTCTTTCCAAAGACC
AGTTAATGATATGAACATTGCTTCTGGTTGTCCTTTGTTTTGCCCAGTCTCAAAGATGGAAGCTAA
AAATTCCTATGTTAGAGATGACGCCATCTTCATTAAGGCTATCGTTGATTTGACTGGTTTAGGTTC
AGCAGGTTCCGCCGCTGGTTCTGGTGAATTTGGTTCCGCCGAAGCAGCCGCTAAGGAAGCAGC
CGCTAAAGCAGGTAGTGCCGGTTCTGCAGCCGGCTCTGGCGAATTTGGTAGTGCCTCTATTAAA
TTGCAATCATCCGACGGTGAAATCTTCGAAGTTGATGTCGAAATAGCAAAGCAATCTGTTACCAT
AAAAACTATGTTGGAAGATTTGGGTATGGATGACGAAGGTGACGATGATCCAGTTCCTTTGCCAA
ATGTCAACGCTGCAATATTGAAGAAAGTTATTCAATGGTGCACACATCACAAGGACGATCCACCT
CCACCTGAAGACGATGAAAATAAGGAAAAGAGAACTGACGATATTCCAGTATGGGACCAAGAAT
TCTTGAAGGTTGATCAAGGTACATTGTTCGAATTGATCTTGGCCGCTAACTATTTGGACATCAAG
GGTTTGTTAGATGTAACATGTAAAACCGTTGCTAACATGATCAAGGGTAAAACACCAGAAGAAAT
CAGAAAGACCTTTAATATTAAGAATGATTTCACTGAAGAAGAAGAAGCACAAGTTAGAAAGGAAA
ACCAATGGTGCGGTTCTGGTGCTACTAACTTCTCTTTGTTGAAGCAAGCAGGTGACGTTGAAGAA
AATCCAGGTCCAATGACTGCTGATAATAACTCTATGCCACATGGTGCCGTATCTTCATACGCTAA
GTTGGTTCAAAACCAAACACCTGAAGATATCTTGGAAGAATTCCCAGAAATCATCCCTTTGCAAC
AAAGACCAAACACTAGATCCAGTGAAACATCCAACGATGAAAGTGGTGAAACCTGTTTTTCAGGT
CATGACGAAGAACAAATTAAATTGATGAACGAAAACTGCATCGTATTGGATTGGGATGACAATGC
AATAGGTGCCGGTACTAAGAAAGTTTGTCATTTGATGGAAAACATAGAAAAGGGTTTGTTGCACA
GAGCTTTCTCCGTTTTTATATTCAATGAACAGGGTGAATTGTTATTGCAACAAAGAGCAACAGAAA
AGATCACCTTTCCAGATTTGTGGACTAATACATGTTGCTCTCATCCTTTGTGCATTGATGACGAAT
TAGGTTTGAAGGGTAAATTGGATGACAAAATTAAGGGTGCTATAACTGCTGCAGTCAGAAAATTA
GATCATGAATTGGGTATACCAGAAGACGAAACCAAGACTCGTGGTAAATTCCATTTCTTAAACAG
AATCCACTATATGGCTCCATCTAACGAACCTTGGGGTGAACATGAAATCGATTACATCTTATTTTA
CAAGATTAATGCAAAGGAAAACTTGACAGTTAACCCAAACGTTAATGAAGTCAGAGATTTCAAAT
GGGTTTCTCCTAATGATTTGAAGACCATGTTTGCTGACCCATCATATAAGTTTACTCCTTGGTTCA
AGATCATCTGTGAAAACTACTTGTTTAACTGGTGGGAACAATTAGATGACTTGTCTGAAGTTGAAA
ACGATAGACAAATCCATAGAATGTTGAAATTGTCTGGTGGTGGTGGTTCTGGTGGTGGTGGTTCT
GGTGGTGGTGGTAGTGCCGAAGCTTGGTACAATTTGGGTAACGCTTACTACAAGCAGGGTGACT
ACCAAAAGGCAATCGAATACTACCAAAAGGCCTTGGAATTGGACCCAAATAACGCAGAAGCCTG
GTATAATTTGGGTAATGCATATTATAAACAGGGTGACTATCAAAAGGCTATTGAATATTACCAAAA
GGCATTGGAATTGGACCCTAATAACGCTGAAGCATGGTATAATTTGGGTAACGCCTATTATAAGC
AGGGTGACTATCAAAAAGCCATCGAAGACTACCAAAAGGCTTTGGAATTGGATCCAAACAACTTA
CAAGCCGAAGCTTGGAAGAATTTGGGTAACGCTTATTACAAACAGGGTGACTACCAAAAGCTAT
TGAATACTATCAAAAAGCCTTAGAATTAGACCCTAATAACGCATCTGCCTGGTACAATTTGGGTAA
```

Figure 15B (continued)

```
TGCCTATTACAAGCAGGGTGACTATCAGAAGGCTATTGAATACTACCAAAAAGCATTGGAATTGG
ATCCAAATAACGCTAAGGCATGGTACAGACGTGGTAATGCCTATTACAAGCAGGGTGACTATCAA
AAGGCGATTGAAGATTATCAAAAAGCTTTGGAATTGGATCCTAACAACAGATCTAGATCAGCTGG
TGGTGGTGGTTCTGGTGGTGGTGGTTCTGGTGGTGGTGGTGCTTCTTCATATTACCATCACCAT
CACCATCACTTAGAATCCACAAGTTTGTACAAAAAGGCTGGTTCTGGTTCAAACACCGTTAAGGA
ATTAAAGAACTACATCCAAGAATTGGAAGAAAGAAACGCAGAATTGAAAAATTTGAAGGAACATTT
GAAGTTTGCCAAGGCTGAATTAGAATTCGAATTGGCCGCTCACAAATTTGAAGGTTCCGCTGGTA
GTGCAGCCGGTTCCGGTGAATTCGGTAGTGCAGAAGCTGCAGCCAAAGAAGCTGCAGCCAAGG
CTGGTTCTGCAGGTTCAGCTGCAGGTTCTGGTGAATTTGGTTCCAGTTACTATCACCATCACCAT
CATCACTTAGAATCCACAAGTTTGTATAAAAAGGCCGGTTCTGGTTCACAAAAAGTCGCACAATT
AAAGAATAGAGTAGCCTACAAGTTGAAGGAAAACGCTAAGTTGGAAAACATTGTCGCAAGATTAG
AAAACGATAATGCCAACTTGGAAAAAGACATCGCTAATTTGGAAAAGGATATTGCAAACTTGGAA
AGAGATGTTGCCAGAGGTTCTGGTGCTACTAACTTCTCTTTGTTGAAGCAAGCAGGTGACGTTGA
AGAAAATCCAGGTCCAATGGAAGCTAAGATAGATGAATTGATAAATAACGACCCAGTTTGGTCTT
CACAAAACGAATCCTTGATCAGTAAGCCATACAACCATATCTTGTTAAAACCTGGTAAAAATTTCA
GATTAAATTTGATCGTACAAATCAACAGAGTTATGAATTTGCCTAAGGATCAATTGGCTATCGTTT
CTCAAATAGTCGAATTGTTGCATAACTCCAGTTTGTTGATCGATGACATCGAAGATAACGCACCA
TTGAGAAGAGGTCAAACTACATCCCACTTAATTTGGGGTGTCCCTAGTACTATTAATACCGCAAA
CTACATGTACTTCAGAGCCATGCAATTGGTATCACAATTGACCACTAAGGAACCATTGTACCATT
GGTTGATCACAATTTTTAACGAAGAATTGATTAATTTGCACAGAGGTCAAGGTTTGGATATCTATT
GGAGAGACTTCTTACCAGAAATTATACCTACCCAAGAAATGTACTTGAACATGGTAATGAATAAG
ACTGGTGGTTTGTTTAGATTGACCTTGAGATTAATGGAAGCTTTGTCTCCATCTTCACATCACGGT
CATTCATTGGTTCCTTTCATAAACTTGTTGGGTATCATCTATCAAATCAGAGATGACTACTTGAATT
TGAAGGATTTCCAAATGTCCAGTGAAAAGGGTTTCGCAGAAGACATAACTGAGGGTAAATTGTCA
TTCCCAATCGTCCATGCCTTAAACTTCACAAAAACCAAGGGTCAAACCGAACAACACAATGAAAT
CTTAAGAATTTTGTTATTGAGAACTTCTGATAAGGACATAAAGTTGAAGTTGATCCAAATCTTGGA
ATTCGATACCAACTCATTGGCTTACACTAAGAACTTCATCAACCAATTGGTTAACATGATTAAGAA
TGATAACGAAAATAAGTACTTGCCAGATTTGGCCTCCCATAGTGACACTGCTACAAATTTGCACG
ATGAATTGTTGTACATCATCGACCATTTGTCCGAATTGAAATTATCTGGTGGTGGTGGTTCTGGT
GGTGGTGGTTCTGGTGGTGGTGGTAGTGCAGAAGCCTGGTACAACTTGGGTAACGCTTACTACA
AGCAGGGTGACTACCAAAAGGCTATCGAATACTACCAAAAGGCATTGGAATTAGACCCAAATAAC
GCTGAAGCATGGTACAACTTAGGCAACGCATATTATAAACAGGGTGACTATCAAAAGGCCATAGA
ATACTACCAAAAGGCTTTGGAATTGGACCCTAATAACGCCGAAGCTTGGTACAACTTGGGTAATG
CTTATTACAAGCAGGGTGACTATCAAAAGCAATTGAAGACTACCAAAAAGCCTTGGAATTAGAT
CCAAATAACTTGCAAGCAGAAGCCTGGAAGAACTTAGGCAACGCATACTATAAACAGGGTGACT
ACCAAAAAGCCATTGAATATTATCAAAAAGCTTTGGAATTAGACCCTAATAACGCTTCTGCTTGGT
ATAACTTAGGCAATGCCTATTATAAGCAGGGTGACTATCAGAAAGCTATTGAATATTATCAAAAGG
CCTTGGAATTGGACCCAAATAACGCCAAGGCTTGGTACAGACGTGGTAACGCATACTACAAACA
GGGTGACTATCAGAAGGCTATCGAAGATTATCAAAAAGCATTAGAATTAGATCCTAATAACAGAT
CTAGATCAGCTGGTGGTGGTGGTTCTGGTGGTGGTGGTTCTGGTGGTGGTGGTGCTTCTTTGTG
TACTATGAAAAAGGGTCCATCTGGTTACGGTTTTAATTTGCATTCTGATAAGTCAAAGCCTGGTCA
ATTCATAAGATCAGTTGATCCAGACTCCCTGCAGAAGCCAGTGGTTTGAGAGCTCAAGATAGAA
TTGTCGAAGTAAATGGTGTCTGCATGGAAGGTAAACAACACGGTGACGTTGTTTCTGCTATTAGA
GCTGGTGGTGACGAAACTAAGTTATTGGTAGTTGACAGAGAAGGTTCCGCCGGTAGTGCTGCAG
GTTCTGGTGAATTTGGTTCAGCTGAAGCCGCTGCAAAAGAAGCCGCTGCAAAGGCCGGTTCTGC
TGGTTCAGCCGCTGGTTCTGGTGAATTCGGTTCTTCATCCGGTGCTATAATCTATACAGTTGAAT
TGAAGAGATACGGTGGTCCATTAGGTATTACTATATCTGGTACAGAAGAACCATTCGATCCTATC
ATCATCAGTTCTTTGACTAAGGGTGGTTTAGCTGAAAGAACAGGTGCAATCCATATTGGTGACAG
AATATTGGCTATCAATTCATCCAGTTTGAAAGGTAAACCATTGTCAGAAGCTATCCACTTATTGCA
```

Figure 15B (continued)

```
AATGGCAGGTGAAACCGTTACTTTGAAAATCAAAAAGCAAACAGATGCACAACCTGCCTCTTCAG
GTTCTGGT
```

Figure 15C

Complete CAN Gene Cassette Nucleotide Sequence

```
ATGAATCATTTGAGAGCCGAAGGACCAGCTTCTGTCTTAGCAATAGGTACTGCCAATCCAGAGAA
CATCTTGTTACAAGATGAATTTCCTGACTATTACTTCAGAGTTACCAAATCCGAGCATATGACGCA
GTTGAAGGAAAAGTTTAGAAAGATCTGTGATAAGAGTATGATCAGAAAGAGGAACTGCTTCTTAA
ACGAAGAGCATTTGAAGCAAAATCCTAGATTAGTGGAACACGAGATGCAAACATTGGATGCTAG
GCAGGACATGTTAGTTGTCGAAGTTCCTAAATTGGGTAAAGATGCATGTGCCAAAGCTATTAAGG
AATGGGGTCAACCCAAGTCTAAGATAACTCATTTGATTTTTACAAGTGCTAGCACTACAGATATG
CCTGGTGCAGACTATCACTGTGCCAAACTACTTGGTTTATCGCCCTCTGTGAAGAGAGTTATGAT
GTATCAACTAGGTTGCTACGGTGGTGGTACTGTACTTAGAATCGCTAAAGACATTGCAGAAAATA
ACAAGGGTGCCAGGGTCTTGGCTGTATGTTGCGATATTATGGCTTGCTTGTTTAGAGGTCCATCA
GAATCCGATTTGGAGCTGTTGGTTGGTCAAGCTATTTTCGGTGACGGTGCTGCAGCTGTTATTGT
TGGTGCAGAACCTGATGAGTCAGTCGGTGAAGACCAATCTTTGAATTGGTTTCTACCGGTCAAA
CGATTTTACCAAATAGTGAAGGTACAATAGGTGGTCATATCAGAGAAGCTGGTTTGATATTCGAT
TTGCACAAAGACGTTCCTATGCTAATATCTAACAACATCGAAAAGTGTCTGATCGAGGCTTTTAC
CCCCATCGGTATTTCCGATTGGAATAGTATATTCTGGATCACGCATCCAGGTGGTAAAGCAATCC
TGGATAAGGTTGAAGAGAAGCTGCATTTGAAGTCTGATAAGTTTGTCGACAGCAGACATGTATTG
TCGGAACACGGTAACATGTCTTCATCCACAGTGCTGTTCGTTATGGATGAACTTAGAAAGAGATC
TTTGGAAGAGGGTAAAAGCACCACGGGTGACGGTTTTGAATGGGGTGTTCTTTTTGGATTCGGC
CCCGGTTTGACCGTCGAAAGAGTAGTTGTTAGATCTGTACCAATTAAATACAAGTTGTCTGGTGG
TGGTGGTTCTGGTGGTGGTGGTTCTGGTGGTGGTGGTAGTGCAGAAGCCTGGTACAATTTGGGT
AACGCTTACTACAAGCAGGGTGACTACCAGAAGGCTATCGAGTATTACCAAAAAGCACTTGAACT
GGATCCAAATAACGCTGAGGCATGGTATAATTTGGGCAACGCATATTACAAACAGGGTGACTATC
AAAAGGCCATAGAATACTACCAAAAGGCTTTGGAGCTGGATCCTAATAACGCCGAAGCTTGGTA
CAATTTGGGAAATGCCTATTATAAGCAGGGTGACTATCAGAAGGCAATAGAGGACTACCAAAAAG
CCCTAGAACTTGATCCAAATAATTTGCAGGCAGAAGCCTGGAAGAATTTGGGTAATGCTTACTAT
AAACAGGGTGACTATCAGAAAGCTATTGAATACTACCAAAAAGCACTGGAATTGGATCCTAATAA
CGCTTCTGCTTGGTACAATTTGGGCAACGCTTACTACAAACAGGGTGACTACCAAAAGCTATCG
AATATTATCAAAAGGCTCTGGAACTAGATCCAAATAACGCCAAGGCTTGGTATAGAAGGGGAAAT
GCTTATTATAAACAGGGTGACTACCAGAAAGCAATTGAAGACTACCAAAAAGCCCTTGAACTGGA
TCCTAATAACAGATCTAGAAGCGCTGGTGGTGGTGGTTCTGGTGGTGGTGGTTCTGGTGGTGGT
GGTGCTTCTGGTAACAACTTAGAAACATACGAGTGGTACAATAAGTCTATTTCTAGAGATAAGGC
CGAAAAGTTACTACTTGACACCGGTAAAGAAGGTGCTTTTATGGTTAGAGATTCTAGAACTCCAG
GTACTTATACAGTCTCTGTATTCACAAAGGCTATCATCTCAGAAACCCATGTATCAAGCATTACC
ACATCAAGGAAACCAACGACTCTCCTAAAAGATATTACGTGGCAGAAAAGTACGTTTTTGATTCA
ATCCCACTGTTGATTCAATATCATCAGTACAATGGTGGTGGTTTGGTGACTAGATTGAGGTATCC
TGTTTGCGGTGGTAGCGCAGGTTCGGCTGCAGGATCAGGCGAATTTGGTTCCGCCGAGGCCGC
TGCAAAAGAAGCCGCTGCAAAGGCTGGATCTGCAGGCTCAGCCGCTGGTTCTGGAGAATTTGG
TTCTGGTTCTCATCCCTGGTTTTCGGTAAAATTCCAAGAGCAAAGGCCGAAGAAATGTTGTCTA
AACAAAGACACGACGGTGCATTTTTGATAAGGGAAAGTGAGAGCGCACCTGGTGACTTTTCGTT
GTCTGTTAAATTCGGTAATGATGTCCAACATTTCAAGGTATTGAGAGATGGTGCTGGTAAATACTT
TTTGTGGGTCGTAAAGTTCAATTCCTTGAACGAATTAGTGGATTACCATAGATCAACTTCCGTTAG
TAGGAACCAACAGATTTTCTTGAGAGATATCGAACAAGTTCCACAACAGCCTACAGGTTCTGGAG
CTACTAACTTCTCTTTGTTGAAGCAAGCAGGTGACGTTGAAGAAATCCAGGTCCAATGGCTGTA
```

Figure 15C (continued)

```
AAGCATTTGATCGTGTTGAAATTCAAGGATGAAATCACAGAGGCACAAAAGGAAGAGTTTTTCAA
GACCTACGTTAATTTGGTCAACATAATCCCAGCTATGAAAGATGTATACTGGGGTAAAGACGTGA
CCCAAAAGAATAAGGAAGAGGGTTATACCCATATAGTAGAAGTGACGTTCGAATCAGTTGAAACT
ATCCAAGATTACATCATACACCCTGCTCATGTTGGCTTTGGTGACGTCTACAGATCCTTCTGGGA
AAAGTTGCTGATCTTCGATTACACTCCAAGAAGAAATTGTCTGGTGGTGGTGGTTCTGGTGGTG
GTGGTTCTGGTGGTGGTGGTAGTGCAGAAGCCTGGTATAATTTGGGAAACGCTTATTACAAACA
GGGTGACTACCAAAAGGCCATCGAGTATTACCAAAAAGCTCTTGAACTGGACCCAAATAACGCT
GAGGCATGGTATAATTTGGGTAACGCATACTATAAGCAAGGTGACTACCAAAAGGCAATTGAATA
TTACCAAAAGGCCTTGGAGTTAGACCCTAATAACGCCGAAGCTTGGTACAATTTGGGTAATGCCT
ACTATAAACAGGGTGACTATCAAAAGGCTATAGAGGACTACCAGAAAGCACTAGAACTTGATCCC
AATAACTTGCAAGCAGAAGCCTGGAAGAATTTGGGTAATGCCTATTATAAGCAAGGTGACTATCA
AAAAGCTATTGAATACTACCAAAAAGCTCTGGAATTGGACCCTAATAACGCTTCTGCTTGGTATAA
TTTGGGTAATGCATACTACAAGCAAGGTGACTACCAGAAGGCAATAGAGTATTACCAAAAAGCCT
TAGAACTAGACCCAAATAACGCCAAGGCTTGGTACAGAAGGGGTAATGCCTACTACAAGCAGGG
TGACTACCAAAAGCTATTGAGGACTACCAAAAAGCACTTGAACTGGATCCTAATAACAGATCTA
GATCAGCTGGTGGTGGTGGTTCTGGTGGTGGTGGTTCTGGTGGTGGTGGTGCTTCCGGTCAAG
ATAGAAGTGAAGCCACATTGATTAAAAGATTCAAAGGAGAAGGTGTTAGATACAAGGCTAAGCTG
ATCGGTATCGATGAAGTTTCTGCTGCTAGAGGTGACAAATTGTGTCAAGACTCTATGATGAAGCT
GAAGGGCGTTGTCGCAGGTGCCAGATCTAAGGGTGAACATAAGCAAAAGATATTTTGACGATC
TCATTCGGTGGTATTAAAATCTTCGATGAAAAGACTGGTGCTTTACAACATCACCATGCAGTACA
CGAAATCTCTTACATCGCTAAGGATATCACAGACCATAGAGCATTCGGTTACGTTTGCGGTAAAG
AAGGCAATCATAGATTTGTCGCTATTAAAACCGCCCAAGCCGCTGAACCAGTCATCTTGGATTTG
AGAGACTTATTCCAGCTAATCTATGAACTAAAGCAAAGAGAAGAATTGGAAAAGAAAGCTGGTAG
CGCAGGATCGGCAGCCGGTAGCGGAGAATTTGGTTCTGCTGAGGCTGCAGCCAAAGAAGCTGC
AGCCAAGGCCGGCTCTGCTGGTTCAGCTGCAGGCTCTGGTGAATTTGGTTCTGGTTCTCATATG
GGTTCTCAATTTTGGGTAACTTCTCAAAAGACTGAAGCTTCCGAGAGATGTGGTTTGCAAGGCTC
CTATATTTTAAGGGTGGAAGCCGAGAAGCTTACCCTACTTACGCTGGGTGCACAGAGTCAAATAT
TGGAACCCCTGTTGTTCTGGCCATATACTTTATTGAGAAGATACGGTAGAGATAAAGTTATGTTC
AGTTTCGAAGCTGGTAGAAGATGCCCAAGCGGTCCTGGAACTTTTACATTCCAGACATCACAAG
GCAATGATATCTTTCAGGCAGTTGAAGCCGCTATTCAACAGCAAAAAGCCCAGGGTAAAGTCGG
ACAGGCTCAAGACATTCTAAGATTGGAACACCATCACCATCATCATGGTTCTGGTGCTACTAACT
TCTCTTTGTTGAAGCAAGCAGGTGACGTTGAAGAAAATCCAGGTCCAATGGGTTTGTCTTCAGTT
TGTACATTCTCTTTCCAAACGAACTACCATACTTTGCTGAACCCTCACAACAACAATCCCAAAACT
TCTTTGCTTTGCTACAGACATCCAAAAACCCCTATTAAGTATAGCTACAACAATTTCCCATCGAAA
CATTGTAGTACTAAGAGCTTCCATTTGCAAAATAAGTGCTCCGAATCTTTGTCTATCGCTAAGAAC
TCAATTAGAGCTGCAACTACAAATCAGACGGAACCACCTGAGTCGGATAATCACTCTGTAGCCAC
CAAAATTTTGAACTTTGGTAAAGCTTGTTGGAAGCTGCAAAGACCATACACAATAATAGCCTTCAC
CTCCTGTGCTTGCGGTTTGTTTGGTAAAGAACTGTTGCATAACACAAATTTGATTTCGTGGTCTTT
GATGTTCAAGGCATTTTCTTTTTGGTTGCAATCCTTTGCATCGCCTCTTTTACCACGACTATTAAT
CAAATCTATGATTTGCACATCGACAGAATTAATAAGCCCGATTTGCCACTAGCTTCAGGTGAAAT
CTCCGTTAATACTGCATGGATTATGTCAATCATTGTCGCCTTGTTCGGTTTAATCATCACAATTAA
AATGAAAGGTGGTCCATTGTACATCTTCGGCTACTGTTTCGGTATATTCGGTGGTATAGTATATTC
CGTTCCACCTTTTAGATGGAAACAAAACCCCAGTACCGCTTTCTTACTAAATTTCTTGGCACATAT
CATCACAAACTTCACCTTCTACTACGCTTCTAGAGCTGCTTTGGGTTTGCCATTCGAATTAAGACC
ATCTTTTACATTTTTGCTGGCTTTTATGAAATCGATGGGTTCTGCATTGGCCTTGATTAAAGATGC
ATCTGACGTTGAAGGTGACACAAAATTCGGCATCAGTACCTTGGCTAGCAAGTACGGTTCTAGAA
ATTTGACTTTGTTTTGTTCAGGTATCGTATTGTTATCCTACGTGGCAGCCATTTTAGCCGGTATCA
TTTGGCCACAAGCTTTTAACAGTAATGTCATGCTACTTAGCCACGCAATATTGGCCTTCTGGCTG
ATCTTGCAGACGAGAGATTTTGCTTTAACTAATTATGACCCTGAGGCAGGTAGAAGATTCTACGA
```

Figure 15C (continued)

```
ATTCATGTGGAAGCTGTACTACGCTGAATATTTGGTTTACGTCTTTATTAAGTTGTCTGGTGGTGG
TGGTTCTGGTGGTGGTGGTTCTGGTGGTGGTGGTAGTGCTGAAGCATGGTACAACTTAGGCAAC
GCATACTACAAGCAGGGTGACTACCAGAAGGCAATTGAGTATTACCAAAAAGCCTTAGAACTAGA
CCCAAACAATGCCGAGGCTTGGTATAACTTGGGCAATGCTTATTACAAACAGGGTGACTATCAAA
AGGCTATAGAATATTACCAAAAGGCACTTGAGCTGGACCCTAACAATGCAGAAGCCTGGTATAAC
TTAGGCAATGCTTATTACAAGCAGGGTGACTATCAGAAGGCCATCGAGGACTACCAAAAGGCTT
TGGAACTGGATCCAAACAATTTGCAGGCTGAAGCATGGAAGAATTTGGGTAACGCTTACTATAAA
CAGGGTGACTATCAGAAAGCAATAGAATACTACCAAAAAGCCCTAGAACTTGACCCTAACAATGC
CTCTGCTTGGTACAACTTGGGTAATGCTTACTATAAGCAGGGTGACTACCAAAAGCTATCGAAT
ATTACCAAAAAGCACTGGAATTGGACCCAAACAATGCAAAGGCCTGGTATAGAAGAGGTAACGC
CTACTACAAACAGGGTGACTACCAAAAGGCTATTGAAGATTACCAAAAGGCTCTGGAACTAGATC
CTAACAACAGATCTAGATCCGCTGGTGGTGGTGGTTCTGGTGGTGGTGGTTCTGGTGGTGGTG
GTGCTTCTGCAGAATACGTTAGAGCTCTGTTCGATTTCAACGGTAACGATGAAGAGGACTTGCCT
TTTAAGAAAGGTGACATTTTGAGAATCAGGGACAAACCAGAAGAGCAATGGTGGAATGCTGAAG
ATTCTGAGGGTAAAAGAGGAATGATTCCTGTTCCCTATGTCGAAAAGTACGGCTCAGCAGGTTC
CGCTGCAGGATCTGGCGAATTCGGTTCAGCCGAGGCCGCTGCAAAAGAAGCCGCTGCAAAGGC
TGGAAGTGCAGGCAGCGCCGCTGGTTCCGGAGAATTTGGTAGTTTGATTAAACATATGAGAGCC
GAAGCTTTATTCGATTTTACTGGTAACTCCAAACTTGAACTGAATTTCAAGGCAGGTGACGTTATT
TTCTTGTTGAGTAGAATTAATAAGGACTGGTTGGAAGGTACTGTTAGAGGTGCTACTGGAATATT
CCCACTTTCTTTTGTGAAAATCCTGAAGGGCTCAGGTGCTACTAACTTCTCTTTGTTGAAGCAAG
CAGGTGACGTTGAAGAAAATCCAGGTCCAATGAAATGTAGCACTTTTTCTTTCTGGTTCGTTTGC
AAGATCATTTTCTTTTTCTTTTCTTTTAATATCCAAACTTCGATCGCAAATCCAAGAGAAAACTTCT
TAAAGTGTTTCTCACAATACATTCCTAATAACGCCACGAATTTGAAGCTGGTATACACTCAGAACA
ACCCACTGTACATGAGCGTGCTAAACTCGACAATCCATAATTTGAGATTCACTTCCGATACTACA
CCCAAACCATTAGTAATCGTGACACCTTCTCATGTTTCACACATTCAAGGAACCATACTATGCTCT
AAGAAAGTCGGTTTGCAGATTAGAACAAGGTCTGGTGGTCATGATAGTGAAGGCATGTCCTACA
TCAGTCAAGTTCCATTCGTTATCGTCGATTTGAGAAACATGAGGTCTATCAAAATAGACGTTCACT
CACAGACGGCTTGGGTCGAGGCAGGTGCCACTTTGGGAGAAGTTTACTACTGGGTCAACGAAA
AGAATGAAAATTTGTCTCTTGCTGCAGGTTACTGTCCAACTGTCTGCGCTGGTGGTCATTTTGGT
GGTGGTGGTTATGGACCTCTTATGAGAAACTACGGTTTGGCCGCTGATAATATCATTGACGCACA
TTTGGTAAATGTGCACGGTAAAGTTCTAGATAGAAAGTCAATGGGTGAAGATTTGTTTTGGGCAT
TGAGAGGTGGTGGTGCTGAATCCTTTGGTATAATCGTAGCTTGGAAAATTAGATTGGTTGCAGTC
CCAAAGTCTACAATGTTCTCAGTTAAGAAAATTATGGAAATCCATGAGCTGGTAAAGTTGGTGAA
TAAGTGGCAAAACATCGCTTACAAGTACGATAAGGACTTGCTGCTAATGACCCATTTCATCACGA
GAAACATCACTGATAACCAGGGTAAAAATAAGACAGCAATACACACCTACTTCTCTTCAGTTTTCT
TGGGTGGTGTTGATTCCTTAGTGGATTTGATGAATAAGAGTTTCCCTGAACTGGGTATTAAGAAA
ACTGATTGTAGACAATTGAGCTGGATCGACACAATCATATTCTATAGTGGTGTTGTCAACTACGA
TACTGACAACTTCAACAAAGAAATCCTTCTGGATAGAAGTGCCGGACAAAATGGCGCTTTCAAAA
TTAAGTTGGACTACGTTAAAAAGCCTATACCCGAGTCAGTATTTGTGCAGATCCTTGAAAAACTG
TATGAAGAGGATATTGGTGCTGGAATGTACGCATTATATCCATACGGTGGTATAATGGATGAAAT
CTCCGAGAGTGCCATACCATTCCCTCATAGAGCTGGTATCTTGTACGAACTGTGGTACATATGTT
CTTGGGAAAACAAGAGGATAACGAAAGCACTTAAACTGGATCAGGAACATCTATAACTTCATG
ACTCCTTACGTTTCTAAAAACCCCAGATTGGCTTATTTGAATTACAGAGATTTGGACATAGGTATC
AACGATCCTAAAAATCCAAACAACTACACACAAGCAAGAATTTGGGGTGAAAGTACTTCGGTAA
AAATTTCGATAGATTGGTTAAAGTCAAGACCTTAGTTGACCCCAACAACTTTTTCAGAAACGAACA
ATCTATTCCACCTTTGCCTAGACATAGGCACGGCTCTGGTGCTACTAACTTCTCTTTGTTGAAGC
AAGCAGGTGACGTTGAAGAAAATCCAGGTCCAATGAACTGTAGCACTTTTTCTTTTGGTTCGTTT
GCAAGATAATATTTTTCTTTTTGTCCTTTAATATCCAAATCAGTATCGCCAACCCACAGGAAAACT
TTTTAAAGTGTTTCTCTGAGTACATCCCCAACAACCCAGCTAACCCTAAGTTTATATATACACAAC
```

Figure 15C (continued)

```
ATGATCAGCTGTACATGAGCGTATTGAACTCGACCATTCAAAATTTGAGATTCACTTCTGACACTA
CACCTAAGCCCTTGGTCATAGTAACTCCTTCTAATGTCTCACATATACAAGCTTCTATCTTGTGCT
CTAAGAAAGTTGGTTTGCAGATTAGAACAAGGTCTGGTGGTCACGATGCAGAAGGTTTATCCTAT
ATTAGTCAAGTCCCATTTGCCATAGTAGATTTGAGAAATATGCATACTGTGAAAGTTGACATACAC
TCACAGACTGCTTGGGTGGAAGCAGGTGCCACATTGGGAGAGGTTTACTACTGGATCAACGAGA
TGAACGAAAACTTTAGTTTCCCAGGTGGTTACTGTCCCACAGTCGGTGTTGGTGGTCATTTTCT
GGTGGTGGTTATGGAGCTTTAATGAGAAACTACGGTTTGGCTGCAGATAATATCATTGACGCACA
TTTGGTGAACGTTGATGGTAAAGTTCTTGACAGAAAATCAATGGGTGAAGATTTGTTTGGGCTA
TCAGAGGTGGTGGTGGTGAAAATTTCGGTATAATCGCCGCTTGCAAAATTAAGTTGGTTGTCGTA
CCTAGCAAAGCTACTATTTTCTCTGTCAAAAAGAACATGGAAATCCATGGTTTAGTAAAGTTGTTT
AATAAGTGGCAAAACATCGCATACAAGTACGATAAGGATTTGATGCTTACCACGCATTTCAGAAC
TAGGAACATCACAGATAACCATGGTAAAAATAAGACTACAGTTCACGGATACTTCTCTTCAATTTT
CTTGGGTGGTGTTGATTCTCTTGTTGATTTGATGAATAAGTCATTCCCAGAACTGGGTATTAAAAA
GACAGATTGTAAGGAACTGAGCTGGATCGACACCACGATTTTCTATAGTGGTGTGGTTAATTACA
ACACCGCCAACTTCAAAAAGGAAATCTTGCTGGATAGATCCGCTGGTAAAAAGACCGCTTTTTCT
ATTAAACTTGACTACGTTAAGAAACTGATCCCTGAAACTGCAATGGTTAAGATATTGGAGAAGCT
GTACGAAGAGGAAGTCGGCGTAGGCATGTACGTTTTGTATCCATACGGTGGTATAATGGATGAG
ATCTCCGAAAGTGCCATACCATTTCCTCATAGAGCTGGTATCATGTATGAATTATGGTACACCGC
TACGTGGGAGAAGCAAGAAGATAACGAGAAACACATAAACTGGGTCAGATCTGTATACAACTTCA
CTACACCTTACGTTTCTCAGAACCCAAGATTGGCATATTTGAACTACAGAGATTTGGACTTGGGT
AAAACCAACCCCGAATCTCCAAATAACTATACGCAAGCAAGAATTTGGGGTGAAAAGTACTTCGG
TAAAAATTTCAACAGATTGGTGAAGGTTAAGACAAAAGCCGATCCAAACAACTTCTTTAGAAACG
AACAATCTATTCCACCATTGCCACCAAGACATCATGGTTCCGGCGCTACTAACTTCTCTTTGTTGA
AGCAAGCAGGTGACGTTGAAGAAAATCCAGGTCCAATGTCAGAAGAGTCCTTATTTGAATCTTCA
CCACAAAAGATGGAGTACGAAATCACTAACTACTCTGAGAGACATACAGAATTGCCTGGACACTT
CATCGGTTTGAACACAGTTGACAAGCTGGAAGAGTCTCCATTGAGAGATTTCGTCAAGTCCCATG
GTGGTCACACCGTAATTAGTAAGATCTTGATAGCTAACAACGGTATCGCTGCAGTCAAGGAAATT
AGATCTGTTAGAAAGTGGGCATATGAAACCTTTGGTGACGATAGAACGGTCCAATTCGTAGCTAT
GGCAACTCCTGAAGACTTGGAGGCCAATGCTGAATATATCAGAATGGCCGATCAATACATTGAA
GTTCCAGGTGGTACAAATAACAATAACTACGCTAATGTCGACTTAATAGTAGATATCGCTGAAAG
AGCAGACGTGGATGCCGTTTGGGCTGGTTGGGGACATGCTTCCGAAAACCCTTTGTTACCCGAA
AAATTGTCTCAGAGTAAGAGAAAAGTTATTTTTATTGGTCCACCTGGAAATGCAATGAGATCATTA
GGTGACAAGATATCCAGTACTATCGTGGCACAATCAGCCAAAGTTCCATGTATTCCTTGGTCCGG
CACCGGTGTTGACACGGTGCATGTTGATGAAAAGACTGGTTTGGTTTCTGTAGATGACGATATCT
ATCAGAAGGGATGTTGCACTTCACCTGAAGATGGTTTGCAAAAGGCTAAGAGAATCGGTTTCCC
AGTTATGATCAAGGCATCAGAAGGTGGTGGTGGTAAAGGTATCAGGCAGGTCGAAAGAGAAGA
GGATTTCATCGCTCTGTACCATCAAGCCGCTAATGAAATACCCGGTTCTCCAATTTTCATAATGAA
ACTAGCTGGAAGGGCAAGACATTTGGAAGTTCAGCTACTTGCTGACCAATACGGCACTAATATTT
CCTTGTTCGGTAGAGATTGCAGTGTTCAAAGAAGACATCAAAAGATTATCGAAGAGGCACCAGTC
ACTATAGCAAAAGCCGAAACATTTCACGAGATGGAAAAGGCAGCTGTTAGATTGGGTAAATTGGT
CGGATATGTAAGTGCTGGAACAGTCGAATATTTGTACAGCCATGACGATGGTAAATTCTACTTTT
TGGAACTTAACCCAAGATTACAAGTTGAGCACCCTACTACAGAAATGGTTTCTGGTGTTAATTTG
CCAGCTGCACAACTGCAGATTGCTATGGGTATCCCTATGCATAGAATCAGTGATATCAGGACTCT
GTACGGTATGAATCCACACAGCGCTTCGGAGATTGACTTCGAATTCAAAACTCAGGATGCAACTA
AGAAACAAAGAAGACCAATCCCAAAGGGTCATTGTACCGCTTGCAGAATTACGTCCGAAGACCC
CAATGATGGTTTTAAACCATCTGGTGGTACTTTGCACGAACTAAACTTTAGAAGCTCGTCTAATGT
CTGGGGTTATTTCTCAGTAGGCAACAACGGTAACATCCATTCTTTTTCAGATTCCCAGTTCGGTC
ACATCTTCGCATTTGGAGAAAATAGGCAAGCCTCTAGAAAGCATATGGTTGTCGCTCTTAAAGAA
CTGTCAATCAGAGGTGACTTCAGAACCACGGTTGAATACTTAATTAAACTGTTGGAAACTGAAGA
```

Figure 15C (continued)

```
CTTCGAAGATAATACGATTACTACAGGTTGGTTGGACGATTTGATAACCCATAAGATGACGGCAG
AAAAACCTGATCCCACCTTGGCCGTTATCTGTGGTGCCGCTACGAAGGCCTTTTTAGCTTCTGAA
GAGGCTAGACATAAGTACATAGAAAGCCTGCAAAAGGGTCAGGTACTATCGAAAGACTTACTAC
AAACAATGTTTCCTGTGGATTTCATCCACGAAGGTAAAAGATACAAGTTTACTGTTGCTAAGTCTG
GCAACGATAGGTACACGTTGTTCATTAATGGTAGCAAGTGCGACATCATTCTAAGACAACTTTCA
GATGGTGGTTTGCTGATCGCAATTGGTGGTAAATCACATACTATCTATTGGAAGGAAGAGGTCG
CAGCCACAAGATTGAGTGTAGACAGCATGACCACGTTGTTAGAGGTTGAAAACGATCCAACTCA
ATTAAGAACACCATCTCCTGGTAAACTTGTGAAATTTCTGGTTGAAAATGGCGAGCATATAATCAA
GGGTCAACCCTACGCTGAGATTGAAGTTATGAAAATGCAGATGCCATTGGTTTCTCAAGAAAACG
GTATAGTTCAACTACTTAAACAGCCTGGATCAACCATAGTAGCTGGTGACATCATGGCAATTATG
ACGTTAGACGATCCATCCAAGGTGAAACATGCTCTTCCTTTTGAGGGTATGCTGCCCGATTTCGG
TTCTCCAGTTATTGAAGGCACTAAACCAGCATACAAGTTTAAATCGTTGGTTTCTACACTGGAAAA
CATCCTAAAGGGTTACGATAACCAAGTTATTATGAATGCTTCTTTGCAACAGTTGATAGAAGTCTT
GAGAAATCCTAAGTTACCCTATTCAGAATGGAAATTGCATATTAGCGCTCTTCACTCCAGATTGC
CTGCAAAATTGGATGAACAAATGGAAGAGCTAGTCGCTAGATCTTTGAGAAGAGGTGCTGTATTT
CCAGCAAGGCAATTGAGTAAGCTAATTGACATGGCAGTTAAAAACCCAGAATACAACCCTGATAA
ACTGTTGGGTGCCGTAGTGGAACCATTGGCAGATATTGCCCATAAGTACTCTAATGGTTTAGAAG
CTCATGAGCACTCAATCTTCGTGCATTTCTTGGAAGAGTACTACGAGGTTGAAAAATTGTTCAAC
GGTCCTAACGTCAGAGAAGAGAACATCATCCTGAAGTTGAGAGATGAAAACCCAAAGGACTTGG
ATAAAGTCGCTCTTACTGTACTGAGTCATAGCAAGGTTTCTGCCAAAAATAACTTAATCCTAGCTA
TCCTGAAGCACTACCAACCTTTGTGTAAGCTGTCATCCAAAGTTTCTGCAATATTTTCAACTCCAT
TGCAACATATCGTAGAGCTTGAATCTAAGGCTACCGCAAAAGTGGCTTTGCAGGCAAGAGAAATT
TTGATCCAAGGTGCTTTGCCATCAGTTAAAGAAAGAACAGAGCAAATAGAACACATCCTGAAGAG
TAGCGTTGTCAAAGTCGCATACGGTTCGTCTAATCCTAAGAGATCTGAACCCGATTTGAATATAC
TTAAGGATTTGATCGATTCAAATTACGTAGTGTTTGACGTTTTACTACAGTTCTTAACTCATCAAGA
TCCTGTTGTCACAGCTGCAGCCGCTCAAGTCTATATAAGAAGGGCCTATAGAGCTTACACTATCG
GTGACATTAGGGTACACGAAGGCGTGACAGTTCCAATCGTGGAATGGAAATTTCAATTGCCCTC
CGCAGCCTTTAGTACCTTCCCAACGGTAAAGTCAAAAATGGGTATGAACAGAGCTGTTTCTGTTT
CTGATTTGAGCTATGTGGCTAATTCGCAATCATCCCCTTTAAGAGAAGGTATTCTAATGGCTGTG
GACCATTTGGACGATGTTGATGAAATTTTGTCTCAATCTTTGGAAGTTATTCCAAGACACCAAAGT
AGCTCGAATGGTCCCGCTCCAGATAGGTCTGGATCTTCAGCAAGTTTAAGCAACGTAGCCAATG
TGTGTGTTGCTTCCACTGAGGGTTTTGAAAGTGAAGAGGAAATCTTGGTTAGATTGAGAGAAATT
TTGGATTTGAACAAACAAGAATTGATTAATGCTTCCATCAGAAGGATCACATTCATGTTCGGTTTT
AAAGATGGTAGTTACCCTAAGTACTACACCTTTAATGGTCCCAACTACAACGAGAACGAAACTAT
CAGACATATCGAACCTGCCTTAGCTTTCCAATTGGAACTGGGTAGATTGTCAAACTTCAACATCA
AGCCAATTTTCACTGATAACAGAAACATCCATGTGTACGAAGCTGTTTCAAAGACATCCCCATTA
GATAAGAGATTTTTCACCAGAGGCATCATTAGGACGGGTCACATTAGAGATGATATTAGCATACA
AGAGTACTTGACTTCGGAAGCTAACAGATTAATGTCTGACATCCTAGATAATTTGGAAGTTACCG
ACACGTCGAACTCTGATTTGAACCATATCTTTATTAACTTCATCGCAGTGTTCGACATATCTCCTG
AGGATGTTGAAGCTGCATTTGGTGGTTTCTTGGAAAGATTCGGTAAAAGATTGCTGAGATTGAGA
GTCTCCAGTGCTGAAATCAGAATCATCATTAAGGATCCACAAACTGGTGCCCCTGTACCCCTGA
GAGCTTTGATCAATAATGTTTCTGGTTACGTAATTAAAACCGAGATGTACACGGAAGTCAAGAAT
GCTAAGGGTGAATGGGTATTCAAGAGCTTGGGTAAACCCGGCTCGATGCACTTAAGACCAATTG
CAACACCATATCCTGTCAAAGAATGGTTGCAACCTAAGAGATACAAAGCCCACTTAATGGGTACT
ACATACGTTTACGATTTCCCAGAATTGTTCAGACAGGCTTCTTCTTCTCAATGGAAGAATTTTTCC
GCCGACGTTAAGCTGACTGACGATTTCTTTATCAGTAACGAACTAATCGAGGATGAAAATGGTGA
ACTTACAGAGGTTGAAAGAGAGCCAGGAGCAAATGCCATTGGCATGGTCGCTTTTAAGATCACT
GTAAAGACACCAGAATATCCTAGGGGTAGACAATTCGTAGTGGTTGCAAACGACATCACCTTTAA
AATTGGTTCTTTCGGACCTCAAGAAGATGAGTTTTTCAATAAGGTTACTGAATACGCTAGGAAAA
```

Figure 15C (continued)

```
GAGGTATACCAAGAATCTACTTGGCCGCTAATTCTGGAGCAAGGATTGGCATGGCCGAGGAAAT
AGTGCCTTTATTTCAGGTTGCATGGAACGACGCAGCCAACCCAGATAAGGGATTCCAATATTTGT
ATTTGACTTCTGAGGGTATGGAAACATTGAAAAAGTTCGATAAGGAAAACTCAGTGCTGACCGAG
AGAACTGTTATTAATGGAGAGGAAAGGTTCGTAATCAAAACTATAATCGGTTCTGAAGATGGTTT
GGGCGTGGAGTGTCTGAGAGGTAGCGGTTTGATTGCTGGTGCAACTTCTAGAGCTTACCATGAT
ATTTTTACTATCACACTGGTCACTTGCAGATCTGTAGGCATAGGTGCTTATTTGGTTAGATTGGGT
CAAAGGGCCATCCAGGTCGAAGGCCAACCTATTATATTGACTGGTGCCCCCGCTATAAACAAAA
TGCTGGGTAGAGAAGTTTATACCTCCAATTTGCAGTTGGGTGGTACGCAAATCATGTACAATAAC
GGTGTTTCTCATTTGACAGCTGTAGACGATTTGGCTGGTGTGGAAAAGATTGTTGAATGGATGTC
ATATGTGCCAGCTAAAAGAAACATGCCCGTTCCAATATTGGAAACTAAGGACACATGGGATAGAC
CAGTAGATTTTACCCCTACGAATGACGAAACCTATGATGTGAGATGGATGATTGAGGGTAGGGA
AACTGAGTCTGGTTTTGAATACGGTTTGTTCGATAAGGGTTCTTTCTTTGAAACATTATCAGGCTG
GGCCAAGGGTGTCGTAGTGGGAAGAGCTAGATTGGGTGGTATTCCTCTAGGTGTTATTGGTGTA
GAAACTAGAACAGTTGAAAATTTGATCCCCGCAGATCCAGCCAACCCTAATTCTGCTGAAACTTT
AATTCAGGAACCTGGTCAAGTTTGGCATCCCAACTCAGCTTTTAAAACCGCACAGGCCATTAATG
ATTTCAACAACGGTGAACAATTGCCAATGATGATACTGGCTAACTGGAGAGGTTTTTCTGGTGGT
CAAAGGGATATGTTCAACGAAGTTTTGAAGTACGGTAGTTTTATCGTCGACGCACTGGTAGATTA
CAAGCAACCTATCATAATATACATTCCACCAACTGGTGAATTAAGAGGTGGTTCTTGGGTTGTCG
TAGACCCAACCATTAACGCAGATCAGATGGAAATGTACGCCGATGTGAATGCTAGAGCAGGTGT
TTTGGAACCACAAGGAATGGTTGGTATTAAGTTTAGAAGAGAAAAATTGCTGGATACTATGAACA
GATTAGACGATAAGTACAGGGAATTGAGATCTCAACTGAGCAATAAGTCTTTGGCTCCAGAAGTT
CATCAACAGATCTCTAAGCAACTGGCTGATAGGGAAAGAGAATTGTTGCCAATATACGGTCAGAT
CTCATTGCAATTTGCCGACTTACACGATAGGTCATCCAGAATGGTGGCTAAGGGTGTTATTTCAA
AAGAATTAGAGTGGACAGAAGCTAGAAGATTTTTCTTTTGGAGATTGAGAAGAAGATTGAACGAG
GAATATTTGATTAAAAGATTGTCACATCAAGTTGGCGAGGCTTCTAGATTGGAAAAGATCGCAAG
GATTAGATCTTGGTATCCAGCATCAGTCGATCACGAAGACGATAGACAAGTAGCCACTTGGATTG
AGGAAAATTACAAGACACTGGACGATAAGTTGAAGGGTTTAAAGCTAGAATCCTTTGCCCAAGAC
TTGGCTAAAAAGATTAGAAGTGACCATGATAATGCTATCGATGGTTTGAGTGAAGTTATTAAAATG
CTTAGCACTGACGATAAGGAAAAACTGTTGAAGACATTGAAGAAACTGTCTGGTGGTGGTGGTT
CTGGTGGTGGTGGTTCTGGTGGTGGTGGTAGTGCCGAAGCTTGGTATAACTTGGGAAATGCTTA
TTACAAGCAGGGTGACTACCAAAAGGCCATAGAATACTACCAAAAGGCTCTTGAGCTGGATCCT
AATAACGCAGAAGCCTGGTATAACTTAGGCAATGCATACTATAAACAAGGTGACTACCAAAAGGC
AATAGAGTACTACCAAAAGGCCTTGGAATTAGATCCAAATAACGCTGAGGCATGGTATAACTTGG
GCAACGCCTACTATAAACAGGGTGACTATCAAAAGGCTATAGAAGATTACCAGAAGGCACTAGA
GCTTGATCCTAATAACTTGCAAGCCGAAGCTTGGAAGAACTTAGGAAATGCATACTATAAGCAAG
GTGACTATCAAAAGCTATTGAATATTACCAAAAGGCTCTGGAGTTGGATCCAAATAACGCATCT
GCTTGGTACAACTTAGGCAACGCCTACTATAAGCAGGGTGACTATCAAAAGCAATTGAATATTA
TCAAAAGGCCTTAGAGCTAGATCCTAATAACGCTAAAGCATGGTATAGGAGAGGCAATGCATACT
ACAAACAGGGTGACTACCAAAAAGCTATAGAAGATTACCAAAAGGCACTTGAACTGGATCCAAAT
AACAGATCTAGATCCGCTGGTGGTGGTGGTTCTGGTGGTGGTGGTTCTGGTGGTGGTGGTGCTT
CTGGTTCTCATATGAGATTGGGAGCCCAATCTATTCAGCCAACCGCTAACTTAGATAGAACGGAC
GATTTGGTCTATTTGAATGTAATGGAATTGGTTAGAGCTGTTTTGGAGTTGAAAAATGAACTAGCA
CAATTGCCACCAGAAGGTTACGTGGTTGTCGTAAAGAATGTTGGTTTGACTCTTAGAAAGTTGAT
AGGCTCGGTCGACGATTTGCTACCATCTTTGCCATCTTCTTCTAGAACTGAAATAGAGGGTACAC
AAAAGCTTCTGAACAAAGATTTGGCTGAATTGATTAATAAGATGAGATTGGCACAACAGAACGCC
GTTACTTCTTTGTCTGAGGAGTGTAAGAGACAAATGCTAACTGCTTCTCATACTTTGGCTGTTGAT
GCAAAGAACTTGTTAGACGCTGTGGATCAAGCAAAAGTTTTAGCCAATTTGGCTCACCCACCTGC
CGAAGGTTCTGCTGGATCAGCTGCAGGATCCGGCGAATTTGGTTCTGCTGAAGCCGCTGCAAAA
GAGGCTGCTGCAAAAGCTGGATCTGCAGGTAGTGCTGCTGGTAGCGGAGAATTTGGTTCTGGT
```

Figure 15C (continued)

GCCATGGCTACTCCTGGTTCAGAAAACGTTCTACCAAGAGAACCATTGATTGCAACAGCCGTGA
AGTTCTTGCAGAACTCTAGAGTTAGACAATCTCCATTGGCAACTAGAAGAGCATTTTTGAAAAAG
AAAGGTTTGACCGACGAGGAAATTGATATGGCTTTCCAACAGTCCGGTACTGCAGCCGATGAAC
CATCTTCATTGTGGGGAAGTGGC

Figure 15D

Complete SCF Gene Cassette Nucleotide Sequence

ATGGGTTCTGCTGGTTCAGCTGCAGGTTCTGGTGAATTCGGTTCCGCTGGTAGTGCCGCTGGTT
CTGGTGAATTTGGTTCTGCTGGTTCAGCAGCCGGTTCTGGTGAATTCTCCTATTACCATCACCAT
CACCATCACTTGGAATCTACTTCATTATACAAAAAGGCTGGTTCCGGTAGTGCCAGAAACGCTTA
CTTGAGAAAGAAAATTGCTAGATTGAAGAAAGATAATTTGCAATTGGAAAGAGATGAACAAAACTT
GGAAAAGATTATCGCTAATTTGAGAGATGAAATAGCAAGATTGGAAAATGAAGTTGCTTCTCATG
AACAAGGTTCCGCAGGTAGTGCCGCCGGTTCTGGTGAATTTGCTGAAGCCGCTGCAAAGGAAG
CCGCTGCAAAAGCAGGTTCTGCCGGTTCAGCCGCTGGTAGTGGTGAATTTTCTTACTATCACCAT
CACCATCATCACTTGGAATCTACCTCATTATATAAAAAGGCCGGTTCCGGTAGTAACTTGGTTGC
TCAATTAGAAAATGAAGTCGCATCATTGGAAAACGAAAACGAAACTTTGAAAAAGAAAAACTTACA
TAAGAAAGATTTGATCGCTTACTTAGAAAAGGAAATAGCAAATTTGAGAAAGAAAATAGAAGAAG
GTTCCGCTGGTAGTGCAGCCGGTAGTGGTGAATTCGGTTCTGCTGAAGCTGCAGCCAAGGAAG
CTGCAGCCAAAGAAGCCGCTGCTAAAGAAGCTGCAGCCAAAGCTGGTTCTGCAGGTTCTGCCG
CAGGTTCCGGTGAATTTGGTTCTTCATACTATCACCATCACCACCACCACTTGGAATCTACCTCA
TTATACAAGAAAGCTGGTTCCGGTAGTCAAAAGGTCGCTGAATTGAAAAACAGAGTAGCTGTTAA
GTTGAACAGAAACGAACAATTGAAAAATAAGGTAGAAGAATTGAAAAATAGAAACGCTTACTTGA
AAAACGAATTGGCAACTTTGGAAAACGAAGTAGCTAGATTAGAAAACGATGTTGCTGAAGGTTCT
GCTGGTTCTGCTGCTGGTTCTGGTGAATTCGCTGAAGCAGCCGCTAAGGAAGCAGCCGCTAAA
GCCGGTTCCGCCGGTTCTGCTGCGGGCTCTGGTGAATTTTCCTACTATCACCATCATCATCACC
ACTTGGAATCTACATCATTATATAAGAAAGCCGGTTCCGGTAGTAATGAAGTTACTACATTGGAAA
ACGATGCTGCTTTTATTGAAAACGAAAACGCATACTTAGAAAAGGAAATCGCTAGATTGAGAAAG
GAAAAGGCCGCTTTGAGAAATAGATTAGCTCATAAGAAAGGTTCTGCTGGTAGCGCTGCTGGCT
CTGGTGAATTTGGTTCCGCCGAAGCCGCTGCTAAGGAAGCCGCTGCCAAAGAAGCCGCTGCCA
AGGAAGCCGCTGCTAAGGCTGGTTCCGCCGGTTCAGCTGCAGGCTCTGGTGAATTCGGTTCTA
GACCACCTACCATCTCTAATCCACCTCCATTGATTTCCAGTGCTAAACATCCATCCGTCGGTAGT
GCAGGTTCCGCTGCCGGCTCTGGCGAATTTGCCGAAGCTGCTGCCAAAGAAGCAGCCGCTAAA
GCTGGTTCAGCAGGTTCCGCTGCCGGATCTGGCGAATTCAATTTCTTGCAATCTAGACCAGAAC
CTACTGCTCCTCCAGAAGAAAGTTTCAGATCTGGTGGTTCAGCTGGTTCCGCCGCAGGATCTGG
CGAATTTGGTTCCGCAGAAGCTGCCGCTAAAGAAGCTGCTGCAAAAGAAGCAGCCGCCAAAGAA
GCTGCTGCAAAAGCCGGTAGTGCTGGTTCAGCTGCCGGTTCCGGTGAATTCGGTTCTTCAAAAG
GTACCGGTTTAAATCCAAACGCTAAAGTTTGGCAAGAAATTGCTCCTGGTAACGGTTCTGCAGGT
TCCGCAGCTGGTTCCGGTGAATTCGCCGAGGCCGCTGCTAAGGAAGCAGCAGCCAAAGCAGGT
AGTGCTGGTTCCGCAGCTGGTTCAGGTGAATTCCCAGACGGTGGTACCACTTTCGAACATTTGT
GGTCCAGTTTAGAACCTGATTCTACATACGGTTCTGCCGGTTCTGCAGCAGGCAGCGGTGAATT
CGGTTCTGCCGAAGCTGCTGCTAAAGAAGCTGCTGCCAAGGAAGCTGCTGCTAAGGAAGCTGC
TGCCAAAGCCGGTAGTGCAGGTTCTGCTGCCGGTTCAGGTGAATTTGGTTCTTCTTACTATCACC
ACCACCACCATCACTTGGAATCTACATCATTATACAAGAAAGCCGGTTCTGGTAGTAAGAGAATC
GCATACTTAAGAAAGAAAATCGCTGCATTGAAGAAAGATAACGCAAACTTAGAAAAGGACATCGC
TAACTTGGAAAACGAAATCGAAAGATTGATTAAAGAAATCAAAACCTTGGAAAATGAAGTTGCATC
TCATGAACAAGGTTCAGCCGGTTCTGCAGCGGGCTCCGGTGAATTTGCCGAAGCTGCAGCAAAA
GAAGCTGCCGCTAAGGCTGGTAGTGCTGGTTCTGCTGCAGGCAGCGGTGAATTTTCTTACTACC

Figure 15D (continued)

```
ACCATCACCACCATCACTTGGAATCTACTTCATTATATAAGAAAGCAGGTTCTGGTAGTAACTTGT
TAGCAACATTAAGATCTACCGCTGCAGTCTTGGAAAACGAAAACCATGTATTGGAAAAAGAAAAG
GAAAAATTGAGAAAGGAAAAAGAACAATTGTTGAATAAGTTGGAAGCTTACAAAGGTTCAGCAGG
TTCTGCAGCGGGCTCTGGCGAATTCGGTTCCGCCGAAGCTGCAGCAAAGGAAGCTGCAGCTAA
AGAGGCCGCTGCAAAAGAAGCTGCTGCCAAAGCAGGTAGTGCAGGTTCCGCAGCCGGCTCCG
GCGAATTTGGTTCACCAGCTACATCCCAACATCCTCCACCTCCACCTGGTCATAGATCTCAAGCT
CCTTCACATGGTTCCGCAGGTAGTGCAGCTGGATCTGGCGAATTCGCCGAAGCTGCCGCTAAG
GAAGCTGCTGCAAAAGCTGGTTCCGCTGGTTCAGCAGCAGGTTCCGGTGAATTCGAATTGAATT
CTTTGTTGATATTGTTAGAAGCAGCCGAATATTGGAAAGAAGAGATAGAGGTTCTGCCGGTAGT
GCTGCAGGTAGCGGCGAATTTGGTTCTGCAGAAGCAGCCGCCAAGGAAGCAGCTGCAAAAGAA
GCAGCAGCTAAAGAAGCAGCTGCAAAAGCCGGTTCTGCTGGTTCAGCCGCAGGATCTGGAGAA
TTCGGTTCCAGACCACCTACAATTTCCAATCCACCTCCATTGATCTCTTCTGCCAAGCATCCATC
CGTTGGTAGTGCAGGTTCAGCTGCCGGTAGTGGTGAATTTGCCGAAGCCGCCGCTAAGGAAGC
CGCCGCCAAAGCAGGTTCAGCCGGTTCCGCCGCAGGTTCAGGTGAATTCAATTTCTTGCAGTCA
AGACCAGAACCTACCGCTCCTCCAGAGGAGAGTTTCAGATCTGGTGGTAGTGCCGGTTCAGCTG
CCGGCTCTGGAGAATTTGGTTCTGCAGAGGCTGCTGCCAAGGAAGCCGCAGCTAAAGAAGCCG
CTGCGAAAGAAGCCGCCGCTAAAGCTGGTAGTGCAGGTAGTGCTGCGGGATCTGGCGAATTCG
GTTCTTCTAAGGGTACTGGTTTGAACCCTAATGCCAAGGTCTGGCAAGAAATCGCCCCTGGTAA
CGGTTCCGCAGGTTCCGCCGCAGGTAGTGGTGAATTCGCCGAGGCTGCCGCCAAGGAAGCCG
CCGCTAAGGCAGGTAGTGCTGGTTCAGCGGCCGGCTCTGGTGAATTTCCAGACGGTGGTACAA
CCTTTGAGCATTTGTGGTCCAGTTTAGAACCTGATTCTACGTACGGTTCTGCTGGTTCCGCTGCA
GGATCTGGCGAATTCGGTTCCGCGGAAGCCGCCGCAAAAGAAGCCGCCGCCAAAGAAGCCGC
CGCAAAGGAAGCCGCAGCAAAGGCAGGTAGTGCCGGCTCCGCCGCTGGCAGTGGCGAATTTG
GTTCTTCATATTATCACCATCATCATCACTTGGAATCTACTTCATTATACAAGAAAGCAGGTT
CCGGTTCTAAAAGAATTGCTTACTTAAGAAAGAAAATCGCGGCTTTGAAGAAAGACAATGCTAAC
TTAGAAAAAGATATTGCCAACTTGGAAAATGAAATCGAAAGATTAATTAAGGAAATTAAAACATTG
GAAAACGAAGTTGCATCACATGAACAAGGTTCAGCTGGTTCCGCTGCAGGGTCCGGCGAATTTG
CAGAAGCCGCCGCCAAGGAAGCCGCAGCCAAAGCTGGTAGTGCAGGTTCTGCCGCTGGCTCTG
GCGAATTTTCTTACTATCATCATCACCATCACCACTTGGAATCTACTTCATTATACAAGAAAGCGG
GTTCAGGTTCTAACTTGTTAGCAACTTTAAGATCTACAGCCGCTGTTTTAGAAAATGAAAACCATG
TCTTAGAAAAAGAAAAGGAAAAGTTGAGAAAGGAAAAGGAACAATTATTAAATAAGTTAGAAGCC
TACAAGGGTTCAGCAGGTTCCGCAGCAGGCTCAGGCGAATTTGGTTCTGCAGAAGCGGCTGCT
AAGGAAGCTGCCGCAAAGGAAGCAGCTGCTAAGGAGGCCGCTGCAAAGGCTGGTTCTGCTGGT
TCCGCCGCGGGCTCTGGAGAATTCGGTTCCGCTTTGGTTGATGACGCCGCTGATTATGAACCTC
CACCTTCAAATAACGAAGAAGCTTTAGGTTCCGCTGGTTCCGCTGCAGGTTCCGGCGAGTTCGC
AGAAGCCGCAGCAAAAGAAGCCGCAGCTAAGGCAGGTAGTGCCGGATCCGCCGCTGGCAGTG
GAGAATTCAGAGAATTGTTCGATGACCCATCTTACGTCAACGTACAAAATTTGGATAAAGCTAGA
CAAGGTTCCGCCGGTTCTGCAGCGGGATCTGGGGAATTTGGTTCTGCAGAAGCTGCCGCCAAA
GAAGCTGCAGCTAAAGAAGCCGCAGCCAAAGAAGCTGCTGCTAAGGCCGGTTCTGCTGGTTCT
GCCGCAGGATCTGGGGAATTCGGTTCCAAGAATACTAAGAGTATGAACTTCGATAACCCAGTTTA
CAGAAAGACTACAGAAGAAGAAGGTTCAGCCGGTTCAGCCGCCGGTTCCGGTGAATTTGCAGA
GGCTGCCGCTAAGAGGCTGCCGCTAAGGCCGGTAGTGCTGGTTCTGCAGCCGGCTCCGGAG
AATTCAGATCTTTGCCATCCACATGGATTGAAAACAAATTATACGGCATGTCAGACCCTAATTGG
GGTTCTGCAGGTTCAGCTGCGGGATCTGGTGAATTCGGTTCAGCAGAAGCCGCAGCCAAGGAA
GCCGCTGCAAAGGAGGCCGCTGCCAAAGAAGCAGCTGCTAAGGCTGGTTCAGCCGGTTCCGCA
GCCGGCAGTGGTGAATTTGGTAGTGTTGTCGATAATTCTCCACCTCCAGCTTTGCCTCCAAAGAA
AAGACAATCTGCTCCATCTGGTTCAGCAGGTTCAGCCGCTGGTTCAGGTGAATTTGCCGAAGCA
GCTGCCAAGGAAGCTGCCGCCAAGGCGGGCAGTGCAGGTTCGGCTGCGGGGTCTGGTGAATT
CACTCAAAGATCTAAACCACAACCTGCAGTTCCTCCAAGACCATCTGCTGACTTGATTTTAGGTT
```

Figure 15D (continued)

```
CCGCCGGTTCCGCAGCTGGCTCTGGCGAATTCGGTTCCGCTGAGGCTGCCGCTAAAGAAGCGG
CCGCTAAAGAGGCAGCCGCTAAAGAGGCGGCCGCTAAAGCAGGTTCTGCAGGTTCAGCAGCAG
GTAGTGGTGAATTTGGTTCTACAGATGAAGAAAGAGAAGAAACCGAAGAAGAAGTTTATTTGTTG
AACTCTACCACTTTGGGTTCAGCTGGTTCTGCTGCGGGTTCTGGCGAATTTGCAGAAGCAGCTG
CTAAGGAAGCCGCGGCAAAGGCTGGTTCTGCGGGCTCCGCCGCAGGTTCTGGTGAATTTGATG
GTAATGTATCTGGTACTCAAAGATTAGACTCAGCTACCGTTAGAACTTATTCATGCGGTTCTGCC
GGTAGTGCAGCGGGCTCTGGGGAATTCGGTTCCGCAGAAGCCGCTGCAAAAGAAGCCGCTGCA
AAAGAAGCCGCTGCGAAGGAGGCTGCTGCTAAGGCAGGTTCCGCCGGTAGTGCTGCGGGTTCC
GGCGAATTTGGTTCCAGTTACTATCACCATCATCACCACCACTTGGAATCCACAAGTTTATATAA
GAAAGCTGGTTCTGGTTCACAAAAGGTAGCTCAATTGAAAAATAGAGTTGCATACAAGTTGAAGG
AAAACGCTAAGTTGGAAAACATAGTAGCAAGATTAGAAAACGATAACGCTAATTTGGAAAAGGAC
ATCGCAAATTTGGAAAAGGATATAGCTAACTTGGAAAGAGATGTTGCTAGAGGTTCTGCTGGTAG
TGCCGCAGGCTCTGGCGAATTCGCTGAAGCTGCCGCTAAAGAGGCTGCGGCTAAAGCTGGTTC
AGCTGGTTCTGCAGCGGGGTCTGGTGAATTTTCTTATTATCACCATCATCACCATCACTTGGAAT
CCACCAGTTTATACAAGAAAGCCGGCTCTGGTTCAAACACTGTTAAGGAATTGAAAAATTACATT
CAAGAATTGGAAGAAAGAAACGCTGAATTGAAAAATTTGAAGGAACATTTGAAGTTTGCAAAAGC
CGAATTGGAATTCGAATTAGCAGCCCATAAATTTGAAGGTTCTGCCGGTTCTGCCGCCGGATCT
GGAGAATTTGGTTCTGCGGAGGCTGCCGCTAAAGAAGCCGCCGCTAAAGAGGCTGCAGCTAAG
GAAGCTGCAGCAAAGGCTGGTTCTGCCGGTTCCGCTGCCGGCTCCGGCGAATTTGGTTCACAT
GATGACTCCTTGCCACATCCTCAACAAGCTACAGATGACTCTGGTCATGAATCCGACGGTTCCG
CAGGCTCTGCTGCCGGCTCCGGCGAGTTTGCTGAAGCCGCTGCTAAAGAGGCTGCTGCTAAAG
CCGGTTCTGCCGGTTCAGCAGCTGGATCTGGAGAATTTGGTTCCCCAAATGCTGGTAGTGTTGA
ACAAACCCCAAAGAAACCTGGTTTGAGAAGAAGAGGTAGTGCTGGTTCTGCCGCTGGCTCCGGA
GAATTTGGTTCAGCCGAAGCTGCGGCCAAAGAGGCTGCTGCAAAGGAGGCTGCGGCTAAGGAA
GCCGCCGCTAAAGCCGGTTCAGCTGGTTCCGCGGCAGGCTCCGGGGAATTTGGTTCTTCTTATT
ATCACCACCACCACCATCACTTGGAATCCACAAGTTTATACAAGAAAGCAGGCTCTGGTTCATTC
GAAAACGTCACTCATGAATTCATTTTGGCAACCTTAGAAAACGAAAACGCTAAGTTGAGAAGATT
AGAAGCAAAGTTGGAAAGAGAATTGGCTAGATTAAGAAATGAAGTAGCTTGGTTGGGTTCTGCG
GGCTCGGCCGCTGGCTCTGGTGAATTCGCCGAAGCTGCGGCCAAGGAGGCTGCCGCAAAGGC
CGGTTCTGCCGGTTCCGCAGCGGGATCCGGCGAATTTTCTTACTACCATCATCACCATCACCAC
TTGGAATCCACAAGTTTATACAAGAAAGCGGGTTCTGGTTCACAAAAAGTTGAAGAATTGAAAAA
TAAGATAGCAGAATTGGAAAACAGAAACGCTGTAAAGAAAAATAGAGTTGCACATTTGAAGCAAG
AAATCGCTTACTTGAAGGATGAATTAGCAGCCCATGAATTCGAAGGTAGTGCCGGTTCCGCTGC
TGGCTCAGGCGAATTTGGTAGTGCAGAAGCTGCCGCTAAGGAGGCTGCCGCCAAAGAAGCAGC
CGCAAAAGAAGCTGCCGCAAAAGCCGGTTCTGCGGGCTCTGCTGCCGGATCCGGCGAATTCGG
TTCAGTCTCCAGTACTAAATTAGTATCCTTTCATGATGACAGTGATGAAGACTTGTTACATATCGG
TTCTGCAGGCTCAGCCGCTGGCTCTGGAGAGTTTGCAGAGGCAGCTGCTAAAGAAGCCGCCGC
AAAGGCAGGTTCTGCAGGTTCTGCAGCTGGTAGTGGTGAATTCGCTGCTGCAACCCCAATATCT
ACTTTTCATGATGACTCAGACGAAGACTTGTTGCATGTCGGTTCCGCAGGTTCAGCAGCGGGAT
CCGGTGAATTTGGTTCAGCAGAAGCTGCCGCCAAGGAGGCCGCTGCTAAAGAAGCAGCAGCCA
AGGAAGCAGCAGCAAAGGCCGGCTCTGCTGGTTCTGCTGCCGGGTCCGGCGAATTTGGTTCTT
CTTATTACCACCATCATCATCACCACTTGGAATCCACAAGTTTATATAAGAAAGCCGGTTCTGGTT
CACAAAAGGTGGAATCATTAAAACAAAGATTGAAGAATTGAAGCAAAGAAAAGCACAATTGAAA
AATGATATTGCCAATTTGGAAAAGGAAATCGCTTACGCAGAAACAGGTAGTGCCGGTTCAGCCG
CGGGCTCTGGTGAATTCGCAGAAGCTGCCGCAAAAGAAGCTGCAGCAAAGCCGGTTCTGCAG
GCTCTGCTGCTGGCTCTGGCGAATTTTCCTACTATCATCATCATCATCACTTGGAATCCACA
AGTTTATACAAGAAAGCGGGTAGTGAATTTTTCAGAAGAGAAAGAAACAAGATGGCAGCCGCTAA
GTGTAGAAACAGAAGAAGAGAATTGACTGATACATTACAAGCTGAAACAGATCAATTAGAAGACG
AAAAATCAGCTTTGCAAACCGAAATCGCAAATTTGTTGAAAGAAAAGAAAAATTGGAATTCATTT
```

Figure 15D (continued)

```
TAGCAGCCCATAGACCAGCTTGCAAAATACCTGATGACTTGGGTTTTCCAGAAGAAATGTCTTTA
GAAGGTAGTGCCGGTAGTGCCGCTGGCTCAGGTGAATTTGGTAGTGCAGAAGCTGCCGCGAAA
GAAGCCGCAGCTAAAGAAGCTGCCGCCAAAGAGGCAGCCGCAAAGGCAGGTTCAGCAGGTTCA
GCTGCCGGGTCCGGGGAATTTGGTTCATTCCAAATGCCAGCTGACACTCCTCCACCTGCATATT
TGCCACCTGAAGATCCTATGACAGGTAGTGCCGGTTCTGCTGCCGGGTCTGGCGAATTCGCTGA
AGCCGCTGCTAAGGAGGCTGCAGCTAAGGCCGGCTCTGCAGGTTCCGCTGCAGGTTCAGGTGA
ATTTGAAAGAGAATCTAACGAAGAACCACCTCCACCTTATGAAGATCCATACTGGGGTAATGGTG
GTTCTGCCGGTAGTGCCGCCGGCTCAGGCGAATTTGGTTCTGCGGAGGCTGCTGCAAAGGAAG
CTGCGGCCAAGGAAGCTGCCGCAAAAGAGGCTGCTGCCAAGGCCGGTTCAGCAGGTTCAGCA
GCTGGGTCCGGTGAATTTGGTTCCAGTTATTATCACCACCATCATCACCACTTGGAATCTACCTC
ATTATATAAGAAAGCGGGTTCCGGTAGTCAAAAAGTTGCAGAATTGAAAAACAGAGTTGCTGTCA
AATTAAATAGAAATGAGCAGTTGAAAAATAAGGTCGAGGAGTTGAAAAATAGAAACGCATACTTG
AAAAATGAATTGGCTACTTTGGAAAACGAAGTCGCAAGATTAGAAAATGATGTAGCTGAAGGCTC
TGCTGGTTCCGCAGCGGGCTCAGGTGAATTCGCCGAAGCAGCCGCAAAGGAAGCTGCCGCTAA
GGCCGGCTCAGCAGGTTCTGCCGCCGGAAGCGGTGAATTTTCTTATTACCACCACCACCATCAC
CACTTGGAATCTACTTCATTATACAAGAAAGCGGGGTCCGGTAGTAACGAAGTCACAACCTTAGA
AAATGATGCAGCCTTTATAGAAAACGAAAATGCCTACTTAGAAAAAGAAATTGCAAGATTGAGAA
AGGAAAAAGCTGCATTGAGAAACAGATTAGCCCACAAGAAATCTTACTATCACCACCATCATCAT
CACTTGGAATCTACATCATTATACAAGAAAGCGGGCTCCGGTAGTGCTAGAAATGCCTACTTAAG
AAAGAAAATAGCCAGATTGAAGAAAGACAATTTGCAATTAGAGAGAGATGAACAGAACTTAGAAA
AGATTATAGCCAATTTGAGAGATGAAATTGCTAGATTAGAAAATGAAGTAGCTTCTCATGAACAAG
GTAGTGCTGGCTCCGCTGCCGGCTCCGGAGAATTTGCCGAAGCTGCCGCCAAGGAAGCCGCG
GCCAAGGCTGGTTCCGCTGGTTCTGCTGCCGGATCTGGAGAATTTTCCTATTACCATCATCATCA
TCATCATTTGGAATCTACATCATTATACAAGAAAGCGGGATCTGGTTCTAACTTGGTCGCCCAATT
GGAGAACGAAGTCGCATCATTGGAGAACGAAAACGAAACCTTGAAGAAAAGAACTTACACAAA
AAGGATTTGATAGCTTACTTAGAAAAAGAAATCGCTAATTTGAGAAAGAAAATTGAAGAAGGTAGT
GCAGGTTCAGCCGCTGGCTCCGGTGAATTTGGTTCAGCGGAGGCTGCCGCTAAGGAGGCAGCC
GCTAAAGAAGCAGCCGCTAAGGAGGCTGCAGCAAAAGCAGGTTCCGCAGGTTCTGCAGCGGGT
TCCGGAGAATTTGGTTCTGAACAAAAGTTGATCTCTGAAGAAGATTTGGAACAAAAGTTGATATC
TGAAGAAGACTTGGAACAAAAATTAATATCAGAAGAAGATTTGGGTAGTGCAGGTTCAGCAGCTG
GTTCTGGAGAATTTGGTTCAGCAGGTTCTGCCGCTGGAAGTGGCGAATTCGGTAGTGCCGGCTC
CGCTGCTGGCTCTGGCGAATTTGGTTCTGGTGCTACTAACTTCTCTTTGTTGAAGCAAGCAGGTG
ACGTTGAAGAAAATCCAGGTCCAATGGGTTCTGCTGGTTCAGCTGCAGGTTCTGGTGAATTTGG
TTCCGCAGGTAGTGCCGCTGGTTCTGGTGAATTCGGTTCTGCTGGTTCAGCAGCCGGTTCTGGT
GAATTTTCATATTACCATCACCATCACCATCACTTGGAATCCACCAGTTTATACAAAAAGGCTGGT
TCTGGTTCAGCTAGAAACGCATATTTGAGAAAGAAAATTGCTAGATTGAAGAAAGATAACTTGCA
ATTGGAAAGAGATGAACAAAATTTGGAAAAGATTATCGCCAACTTAAGAGATGAAATAGCAAGAT
GGAAAACGAAGTAGCTTCTCATGAACAAGGTTCCGCAGGTAGTGCAGCTGGTTCTGGTGAATT
TGCTGAAGCCGCTGCAAAGGAAGCCGCTGCAAAAGCTGGTTCCGCTGGTTCAGCCGCTGGTTC
CGGTGAATTCAGTTACTATCACCATCACCATCATCACTTGGAATCCACAAGTTTATATAAAAAGGC
CGGTTCTGGTTCAAATTTGGTTGCTCAATTAGAAAACGAAGTCGCATCTTTAGAAAACGAAAACG
AAACATTGAAAAGAAAAATTTGCATAAGAAAGATTTGATCGCTTATTTGGAAAAGGAAATCGCAA
ACTTGAGAAAGAAATAGAAGAAGGTTCCGCTGGTTCTGCTGCTGGTTCCGGTGAATTTGGTTCA
GCTGAAGCTGCAGCCAAGGAAGCTGCAGCCAAAGAAGCCGCTGCTAAAGAAGCTGCAGCCAAA
GCAGGTTCTGCCGGTTCTGCCGCAGGTTCCGGTGAATTCGGTTCTTCAGCTACTAGAGAATTGG
ATGAATTGATGGCATCCTTAAGTGACTTCAAGATACAAGGTGGTTCCGCTGGTTCTGCAGCCGG
CTCTGGCGAATTCGCAGAAGCAGCCGCTAAGGAAGCAGCCGCTAAAGCTGGTTCTGCAGGTTC
TGCTGCCGGTTCTGGTGAATTCGATTTGGCTTTGTCTGAAAACTGGGCACAAGAATTCTTGGCTG
CAGGTGACGCTGTTGATGGTTCTGCTGGTAGTGCTGCCGGTTCAGGTGAATTTGGTAGTGCTGA
```

Figure 15D (continued)

```
AGCTGCTGCCAAAGAAGCAGCCGCTAAAGAAGCTGCTGCCAAGGAAGCTGCCGCTAAAGCAGG
TTCCGCCGGTTCTGCCGCCGGCTCCGGCGAATTTGGTTCAGATTATAAGGATGACGATGACAAG
GATTACAAAGACGATGATGACAAGGATTATAAAGATGACGATGACAAAGGTTCCGCTGGTAGTG
CCGCCGGCTCTGGAGAATTCGGTTCTGCCGGTTCAGCTGCCGGCTCCGGAGAATTTGGTTCCG
CTGGTAGTGCAGCCGGTTCAGGTGAATTCGGTTCTGGTGCTACTAACTTCTCTTTGTTGAAGCAA
GCAGGTGACGTTGAAGAAAATCCAGGTCCAATGAGTGCTAAGGCAATTTCTGAACAAACTGGTA
AAGAATTGTTGTACAAGTTTATTTGTACTACATCAGCCATCCAAAATAGATTCAAATACGCTAGAG
TTACCCCAGATACTGACTGGGCTAGATTGTTACAAGATCATCCATGGTTGTTATCTCAAAACTTG
GTTGTCAAACCTGACCAATTAATTAAGAGAAGAGGTAAATTGGGTTTAGTAGGTGTTAATTTGACA
TTGGATGGTGTAAAGTCTTGGTTGAAACCAAGATTAGGTCAAGAAGCCACAGTTGGTAAAGCTAC
CGGTTTCTTGAAAAATTTCTTGATCGAACCATTTGTCCCTCATTCACAAGCCGAAGAATTCTATGT
ATGTATCTACGCTACTAGAGAGGGTGACTATGTTTTATTTCATCACGAAGGTGGTGTCGACGTAG
GTGACGTTGACGCCAAGGCTCAAAAGTTGTTGGTTGGTGTCGATGAAAAGTTGAACCCAGAAGA
CATTAAAAAGCATTTGTTGGTTCACGCACCTGAAGATAAAAAGGAAATATTGGCCTCCTTTATAAG
TGGTTTGTTTAATTTCTACGAAGATTTGTACTTCACCTACTTGGAAATTAACCCATTAGTAGTTACT
AAGGATGGTGTATATGTTTTGGACTTAGCTGCAAAAGTTGATGCAACAGCCGACTACATTTGTAA
GGTCAAATGGGGTGACATCGAATTTCCACCTCCATTCGGTAGAGAAGCTTATCCAGAAGAAGCC
TACATTGCTGATTTGGACGCTAAGTCTGGTGCATCATTGAAGTTGACATTGTTGAACCCTAAAGG
TAGAATTTGGACCATGGTTGCTGGTGGTGGTGCTAGTGTCGTATATTCTGATACTATATGCGACT
TGGGTGGTGTTAACGAATTGGCAAACTACGGTGAATACTCAGGTGCCCCATCCGAACAACAAAC
ATACGATTACGCTAAGACCATCTTGTCCTTAATGACTAGAGAAAAGCATCCTGATGGTAAAATCTT
GATCATCGGTGGTAGTATCGCAAATTTTACTAACGTTGCCGCTACATTCAAGGGTATCGTCAGAG
CTATAAGAGATTACCAAGGTCCATTGAAGGAACACGAAGTAACAATATTCGTTAGAAGAGGTGGT
CCTAACTACCAAGAAGGTTTGAGAGTCATGGGTGAAGTAGGTAAAACCACTGGTATACCAATCCA
TGTCTTTGGTACAGAAACCCACATGACTGCAATAGTTGGTATGGCCTTAGGTCATAGACCAATCC
CTAATCAACCTCCAACCGCAGCCCACACTGCAAATTTCTTGTTAAACGCCTCTGGTTCAACTTCC
ACACCAGCTCCTTCTAGAACAGCAAGTTTCTCTGAATCAAGAGCTGATGAAGTCGCTCCAGCTAA
GAAAGCAAAACCAGCCATGCCTCAAGACTCCGTTCCAAGTCCTAGATCTTTGCAGGGTAAATCTA
CTACTTTGTTTTCTAGACATACTAAGGCTATAGTATGGGGTATGCAAACAAGAGCAGTTCAAGGC
ATGTTGGATTTCGACTATGTTTGTAGTAGAGATGAACCATCTGTTGCTGCAATGGTCTATCCTTTT
ACTGGTGACCATAAGCAAAAATTCTACTGGGGTCACAAGGAAATATTGATCCCAGTTTTTAAGAA
CATGGCCGATGCTATGAGAAAACATCCTGAAGTCGACGTATTGATTAACTTCGCCTCATTAAGAT
CCGCTTACGATTCTACAATGGAAACCATGAACTACGCTCAAATAAGAACCATCGCTATCATTGCA
GAAGGTATTCCAGAAGCCTTGACTAGAAAGTTGATTAAGAAAGCTGATCAAAAAGGTGTCACAAT
AATCGGTCCAGCTACCGTAGGTGGTATTAAGCCTGGTTGTTTCAAGATCGGTAACACTGGTGGT
ATGTTGGATAACATATTGGCATCTAAGTTGTATAGACCAGGTTCAGTCGCTTACGTATCCAGAAG
TGGTGGTATGTCCAACGAATTGAACAACATCATCAGTAGAACTACAGATGGTGTATACGAAGGTG
TTGCTATTGGTGGTGACAGATACCCAGGTTCTACTTTATGGATCATGTATTGAGATATCAAGACA
CACCTGGTGTTAAAATGATTGTTGTCTTGGGTGAAATAGGTGGTACTGAAGAATACAAGATATGC
AGAGGTATCAAAGAAGGTAGATTGACAAAGCCAATCGTTTGTTGGTGCATTGGTACTTGTGCAAC
AATGTTTTCTTCAGAAGTTCAATTCGGTCATGCAGGTGCCTGCGCTAATCAAGCTTCAGAAACAG
CAGTTGCCAAGAACCAAGCATTAAAAGAAGCCGGTGTTTTGTCCCTAGATCTTTCGATGAATTA
GGTGAAATCATTCAATCAGTCTATGAAGACTTGGTAGCTAATGGTGTAATTGTTCCAGCACAAGA
AGTTCCTCCACCTACTGTCCCTATGGATTACTCTTGGGCAAGAGAATTGGGTTTAATTAGAAAGC
CAGCTAGTTTTATGACCTCTATATGTGATGAAAGAGGTCAAGAATTGATCTATGCTGGTATGCCT
ATTACTGAAGTATTCAAAGAAGAAATGGGTATCGGTGGTGTTTTAGGTTTGTTGTGGTTCCAAAA
GAGATTGCCAAAGTACTCTTGTCAATTCATTGAAATGTGCTTAATGGTTACAGCTGATCATGGTCC
TGCTGTCTCAGGTGCACACAATACCATAATCTGCGCTAGAGCTGGTAAAGATTTGGTTTCTTCTT
TGACCTCAGGTTTGTTAACTATTGGTGACAGATTTGGTGGTGCATTAGACGCCGCTGCAAAGATG
```

Figure 15D (continued)

```
TTTTCAAAAGCTTTCGATTCCGGTATAATCCCAATGGAATTCGTTAATAAGATGAAAAAGGAGGGT
AAATTGATAATGGGTATCGGTCATCGTGTTAAGTCTATCAATAACCCTGATATGAGAGTACAAATC
TTGAAGGACTATGTTAGACAACACTTTCCAGCCACACCTTTGTTAGATTACGCTTTGGAAGTTGA
AAAGATTACCACTTCTAAAAAGCCAAATTTGATCTTGAACGTTGATGGTTTAATTGGTGTTGCTTT
TGTCGACATGTTGAGAAACTGTGGTTCCTTCACTAGAGAAGAAGCTGATGAATATATCGACATTG
GTGCATTGAATGGTATCTTTGTTTTAGGTAGATCTATGGGTTTCATTGGTCATTACTTGGATCAAA
AGAGATTAAAGCAAGGTTTGTACAGACATCCATGGGATGACATTTCTTACGTTTTACCTGAACAC
ATGTCAATGAAATTGTCTGGTGGTGGTGGTTCTGGTGGTGGTGGTTCTGGTGGTGGTGGTAGTG
CCGAAGCTTGGTACAATTTGGGTAACGCATACTACAAGCAGGGTGACTACCAAAAGGCAATTGA
ATATTACCAAAAGGCCTTGGAATTAGACCCAAATAACGCAGAAGCCTGGTATAATTTGGGTAATG
CTTATTATAAACAGGGTGACTATCAAAAGGCTATCGAATACTACCAAAAGGCATTGGAATTAGAC
CCTAATAACGCTGAAGCATGGTATAATTTGGGTAACGCTTATTATAAGCAGGGTGACTATCAAAA
AGCCATCGAAGACTACCAAAAGGCTTTGGAATTAGATCCAAATAACTTACAAGCCGAAGCTTGGA
AGAATTTGGGTAACGCTTACTATAAACAGGGTGACTACCAAAAGCAATTGAATACTATCAAAAA
GCTTTAGAATTGGACCCTAATAACGCATCAGCCTGGTACAATTTGGGTAATGCTTACTATAAGCA
GGGTGACTATCAGAAGGCCATTGAATACTATCAAAAGGCTTTAGAATTGGATCCAAATAACGCTA
AAGCATGGTACAGACGTGGTAACGCTTATTACAAACAGGGTGACTACCAGAAAGCCATTGAAGA
TTATCAAAAGGCTTTGGAATTGGATCCTAACAACAGATCTAGATCAGCTGGTGGTGGTGGTTCTG
GTGGTGGTGGTTCTGGTGGTGGTGGTGCTTCTTCATATTACCATCACCATCACCATCACTTGGAA
TCCACAAGTTTATACAAAAAGGCTGGTTCTGGTTCAAATTTGGTCGCACAATTGGAAAACGAAGT
AGCCTCTTTAGAAAATGAAAACGAAACCTTGAAAAGAAAAACTTACATAAGAAAGATTTGATCGC
TTATTTGGAAAAGGAAATCGCAAATTTGAGAAAGAAAATTGAAGAAGGTAGTGCAGGTTCTGCCG
CTGGTTCTGGTGAATTTGGTTCAGCTGAAGCAGCCGCTAAGGAAGCAGCCGCTAAAGCCGGTTC
AGCTGGTTCCGCAGCCGGTTCTGGTGAATTCGGTTCCAGTTACTATCACCATCACCATCATCACT
TGGAATCCACAAGTTTATATAAGAAAGCAGGTTCTGGTTCAGCAAGAAATGCCTACTTGAGAAAG
AAAATAGCTAGATTAAAGAAAGATAACTTGCAATTGGAAAGAGATGAACAAAATTTGGAAAAGATT
ATCGCCAACTTAAGAGATGAAATCGCTAGATTGGAAAATGAAGTTGCATCCCATGAACAAGGTAG
TGGTGCTACTAACTTCTCTTTGTTGAAGCAAGCAGGTGACGTTGAAGAAAATCCAGGTCCAATGA
AAAACTGTGTAATCGTTTCTGCTGTTAGAACTGCAATTGGTTCCTTTAATGGTAGTTTGGCCTCTA
CATCAGCTATTGATTTGGGTGCTACCGTCATCAAAGCTGCAATTGAAAGAGCAAAGATTGATTCT
CAACATGTCGACGAAGTAATAATGGGTAACGTTTTGCAAGCTGGTTTAGGTCAAAATCCAGCAAG
ACAAGCCTTGTTAAAATCTGGTTTAGCAGAAACTGTATGTGGTTTCACAGTTAATAAGGTCTGCG
GTTCTGGTTTGAAGTCAGTTGCTTTAGCCGCTCAAGCTATACAAGCAGGTCAAGCCCAATCTATC
GTCGCTGGTGGTATGGAAAATATGTCATTGGCACCTTATTTGTTAGATGCAAAAGCCAGATCAGG
TTATAGATTAGGTGACGGTCAAGTATACGACGTTATTTGAGAGATGGTTTAATGTGCGCTACTC
ATGGTTATCACATGGGTATTACAGCAGAAATGTTGCCAAAGAATACGGTATAACCAGAGAAATG
CAAGATGAATTGGCATTACATTCCCAAAGAAAGGCAGCCGCTGCAATCGAAAGTGGTGCTTTTAC
TGCAGAAATTGTCCCAGTAAACGTTGTCACAAGAAAGAAAACTTTCGTTTTCTCCCAAGATGAATT
CCCAAAAGCTAATAGTACCGCTGAAGCATTGGGTGCTTTAAGACCTGCATTCGACAAGGCCGGT
ACCGTAACTGCCGGTAATGCTTCTGGTATAAACGATGGTGCCGCTGCATTGGTTATCATGGAAG
AATCAGCCGCTTTAGCAGCCGGTTTGACACCTTTAGCTAGAATTAAATCTTATGCATCAGGTGGT
GTTCCACCTGCTTTGATGGGTATGGGTCCAGTCCCTGCTACCCAAAAGGCATTGCAATTAGCCG
GTTTGCAATTGGCTGATATCGACTTAATCGAAGCAAACGAAGCCTTTGCTGCACAATTCTTGGCA
GTTGGTAAAAATTTGGGTTTCGACTCCGAAAAGGTTAATGTCAACGGTGGTGCCATTGCTTTGGG
TCATCCAATAGGTGCTTCAGGTGCAAGAATCTTGGTTACATTGTTGCATGCCATGCAAGCTAGAG
ATAAAACCTTGGGTTTAGCTACTTTGTGTATCGGTGGTGGTCAAGGTATCGCAATGGTTATCGAA
AGATTGAATAAGTTGTCTGGTGGTGGTGGTTCTGGTGGTGGTGGTTCTGGTGGTGGTGGTAGTG
CAGAAGCCTGGTACAATTTGGGTAACGCTTACTACAAGCAGGGTGACTACCAAAAGGCAATCGA
ATACTACCAAAAGGCCTTGGAATTAGATCCAAATAACGCTGAAGCATGGTATAATTTGGGTAATG
```

Figure 15D (continued)

CCTATTATAAACAGGGTGACTATCAAAAAGCTATTGAATATTACCAAAAGGCATTGGAATTAGATC
CTAATAACGCCGAAGCTTGGTATAATTTGGGTAACGCCTATTATAAGCAGGGTGACTATCAAAAG
GCCATCGAAGATTACCAAAAGGCTTTGGAATTGGATCCAAACAACTTGCAAGCAGAAGCCTGGA
AGAATTTGGGTAACGCTTATTACAAACAGGGTGACTACCAAAAAGCTATTGAATACTATCAAAAA
GCCTTAGAATTGGATCCTAATAACGCTTCTGCATGGTACAATTTGGGTAATGCCTACTATAAACA
GGGTGACTACCAGAAGGCTATTGAATACTACCAAAAAGCATTAGAATTGGATCCAAATAACGCCA
AGGCTTGGTACAGACGTGGTAATGCCTATTACAAGCAGGGTGACTACCAGAAAGCCATAGAAGA
CTATCAAAAAGCCTTGGAATTGGATCCTAACAACAGATCCAGAAGTGCTGGTGGTGGTGGTTCT
GGTGGTGGTGGTTCTGGTGGTGGTGGTGCTTCTTCATATTACCATCACCATCACCATCACTTGGA
ATCTACATCATTATACAAAAAGGCTGGTTCCGGTAGTAATGAAGTTACTACATTGGAAAACGATG
CCGCTTTTATCGAAAACGAAAACGCATACTTGGAAAAGGAAATCGCCAGATTAAGAAAGGAAAG
GCAGCCTTGAGAAATAGATTAGCCCATAAAAAGGGTTCCGCTGGTAGTGCTGCAGGTCTGGTG
AATTTGGTTCAGCTGAAGCCGCTGCAAAAGAAGCCGCTGCAAAGGCAGGTTCTGCCGGTTCAGC
CGCTGGTTCTGGTGAATTCGGTTCCAGTTACTATCACCATCACCATCATCACTTGGAATCTACTT
CATTATATAAAAAGGCCGGTTCCGGTAGTCAAAAGTCGCTGAATTAAAGAACAGAGTAGCTGTT
AAGTTGAACAGAAACGAACAATTGAAAAATAAGGTAGAAGAATTGAAAAATAGAAACGCCTACTT
AAAGAATGAATTGGCAACATTGGAAAACGAAGTCGCTAGATTGGAAAATGATGTAGCAGAAGGTT
CTGGT

Figure 15E

Complete SOL Gene Cassette Nucleotide Sequence

ATGAGTGCTAAGGCAATTTCTGAACAAACTGGTAAAGAATTGTTGTACAAGTTTATTTGTACTACA
TCAGCCATCCAAAATAGATTCAAATACGCTAGAGTTACCCCAGATACTGACTGGGCTAGATTGTT
ACAAGATCATCCATGGTTGTTATCTCAAAACTTGGTTGTCAAACCTGACCAATTAATTAAGAGAAG
AGGTAAATTGGGTTTAGTAGGTGTTAATTTGACATTGGATGGTGTAAAGTCTTGGTTGAAACCAA
GATTAGGTCAAGAAGCCACAGTTGGTAAAGCTACCGGTTTCTTGAAAAATTTCTTGATCGAACCA
TTTGTCCCTCATTCACAAGCCGAAGAATTCTATGTATGTATCTACGCTACTAGAGAGGGTGACTA
TGTTTTATTTCATCACGAAGGTGGTGTCGACGTAGGTGACGTTGACGCCAAGGCTCAAAAGTTGT
TGGTTGGTGTCGATGAAAAGTTGAACCCAGAAGACATTAAAAAGCATTTGTTGGTTCACGCACCT
GAAGATAAAAAGGAAATATTGGCCTCCTTTATAAGTGGTTTGTTTAATTTCTACGAAGATTTGTAC
TTCACCTACTTGGAAATTAACCCATTAGTAGTTACTAAGGATGGTGTATATGTTTTGGACTTAGCT
GCAAAAGTTGATGCAACAGCCGACTACATTTGTAAGGTCAAATGGGGTGACATCGAATTTCCACC
TCCATTCGGTAGAGAAGCTTATCCAGAAGAAGCCTACATTGCTGATTTGGACGCTAAGTCTGGTG
CATCATTGAAGTTGACATTGTTGAACCCTAAAGGTAGAATTTGGACCATGGTTGCTGGTGGTGGT
GCTAGTGTCGTATATTCTGATACTATATGCGACTTGGGTGGTGTTAACGAATTGGCAAACTACGG
TGAATACTCAGGTGCCCCATCCGAACAACAAACATACGATTACGCTAAGACCATCTTGTCCTTAA
TGACTAGAGAAAAGCATCCTGATGGTAAAATCTTGATCATCGGTGGTAGTATCGCAAATTTTACT
AACGTTGCCGCTACATTCAAGGGTATCGTCAGAGCTATAAGAGATTACCAAGGTCCATTGAAGG
AACACGAAGTAACAATATTCGTTAGAAGAGGTGGTCCTAACTACCAAGAAGGTTTGAGAGTCATG
GGTGAAGTAGGTAAACCACTGGTATACCAATCCATGTCTTTGGTACAGAAACCCACATGACTGC
AATAGTTGGTATGGCCTTAGGTCATAGACCAATCCCTAATCAACCTCCAACCGCAGCCCACACTG
CAAATTTCTTGTTAAACGCCTCTGGTTCAACTTCCACACCAGCTCCTTCTAGAACAGCAAGTTTCT
CTGAATCAAGAGCTGATGAAGTCGCTCCAGCTAAGAAAGCAAAACCAGCCATGCCTCAAGACTC
CGTTCCAAGTCCTAGATCTTTGCAGGGTAAATCTACTACTTTGTTTTCTAGACATACTAAGGCTAT
AGTATGGGGTATGCAAACAAGAGCAGTTCAAGGCATGTTGGATTTCGACTATGTTTGTAGTAGAG
ATGAACCATCTGTTGCTGCAATGGTCTATCCTTTTACTGGTGACCATAAGCAAAAATTCTACTGG
GGTCACAAGGAAATATTGATCCCAGTTTTTAAGAACATGGCCGATGCTATGAGAAAACATCCTGA

Figure 15E (continued)

```
AGTCGACGTATTGATTAACTTCGCCTCATTAAGATCCGCTTACGATTCTACAATGGAAACCATGA
ACTACGCTCAAATAAGAACCATCGCTATCATTGCAGAAGGTATTCCAGAAGCCTTGACTAGAAAG
TTGATTAAGAAAGCTGATCAAAAAGGTGTCACAATAATCGGTCCAGCTACCGTAGGTGGTATTAA
GCCTGGTTGTTTCAAGATCGGTAACACTGGTGGTATGTTGGATAACATATTGGCATCTAAGTTGT
ATAGACCAGGTTCAGTCGCTTACGTATCCAGAAGTGGTGGTATGTCCAACGAATTGAACAACATC
ATCAGTAGAACTACAGATGGTGTATACGAAGGTGTTGCTATTGGTGGTGACAGATACCCAGGTT
CTACTTTTATGGATCATGTATTGAGATATCAAGACACACCTGGTGTTAAAATGATTGTTGTCTTGG
GTGAAATAGGTGGTACTGAAGAATACAAGATATGCAGAGGTATCAAAGAAGGTAGATTGACAAA
GCCAATCGTTTGTTGGTGCATTGGTACTTGTGCAACAATGTTTTCTTCAGAAGTTCAATTCGGTCA
TGCAGGTGCCTGCGCTAATCAAGCTTCAGAAACAGCAGTTGCCAAGAACCAAGCATTAAAAGAA
GCCGGTGTTTTTGTCCCTAGATCTTTCGATGAATTAGGTGAAATCATTCAATCAGTCTATGAAGAC
TTGGTAGCTAATGGTGTAATTGTTCCAGCACAAGAAGTTCCTCCACCTACTGTCCCTATGGATTA
CTCTTGGGCAAGAGAATTGGGTTTAATTAGAAAGCCAGCTAGTTTTATGACCTCTATATGTGATG
AAAGAGGTCAAGAATTGATCTATGCTGGTATGCCTATTACTGAAGTATTCAAAGAAGAAATGGGT
ATCGGTGGTGTTTTAGGTTTGTTGTGGTTCCAAAAGAGATTGCCAAAGTACTCTTGTCAATTCATT
GAAATGTGCTTAATGGTTACAGCTGATCATGGTCCTGCTGTCTCAGGTGCACACAATACCATAAT
CTGCGCTAGAGCTGGTAAAGATTTGGTTTCTTCTTTGACCTCAGGTTTGTTAACTATTGGTGACA
GATTTGGTGGTGCATTAGACGCCGCTGCAAAGATGTTTTCAAAAGCTTTCGATTCCGGTATAATC
CCAATGGAATTCGTTAATAAGATGAAAAAGGAGGGTAAATTGATAATGGGTATCGGTCATCGTGT
TAAGTCTATCAATAACCCTGATATGAGAGTACAAATCTTGAAGGACTATGTTAGACAACACTTTCC
AGCCACACCTTTGTTAGATTACGCTTTGGAAGTTGAAAAGATTACCACTTCTAAAAAGCCAAATTT
GATCTTGAACGTTGATGGTTTAATTGGTGTTGCTTTTGTCGACATGTTGAGAAACTGTGGTTCCTT
CACTAGAGAAGAAGCTGATGAATATATCGACATTGGTGCATTGAATGGTATCTTTGTTTTAGGTA
GATCTATGGGTTTCATTGGTCATTACTTGGATCAAAAGAGATTAAAGCAAGGTTTGTACAGACAT
CCATGGGATGACATTTCTTACGTTTTACCTGAACACATGTCAATGAAATTGTCTGGTGGTGGTGG
TTCTGGTGGTGGTGGTTCTGGTGGTGGTGGTAGTGCCGAAGCTTGGTACAATTTGGGTAACGCA
TACTACAAGCAGGGTGACTACCAAAAGGCAATTGAATATTACCAAAAGGCCTTGGAATTAGACCC
AAATAACGCAGAAGCCTGGTATAATTTGGGTAATGCTTATTATAAACAGGGTGACTATCAAAAGG
CTATCGAATACTACCAAAAGGCATTGGAATTAGACCCTAATAACGCTGAAGCATGGTATAATTTG
GGTAACGCTTATTATAAGCAGGGTGACTATCAAAAGCCATCGAAGACTACCAAAAGGCTTTGGA
ATTAGATCCAAATAACTTACAAGCCGAAGCTTGGAAGAATTTGGGTAACGCTTACTATAAACAGG
GTGACTACCAAAAGCAATTGAATACTATCAAAAGCTTTAGAATTGGACCCTAATAACGCATCA
GCCTGGTACAATTTGGGTAATGCTTACTATAAGCAGGGTGACTATCAGAAGGCCATTGAATACTA
TCAAAAGGCTTTAGAATTGGATCCAAATAACGCTAAAGCATGGTACAGACGTGGTAACGCTTATT
ACAAACAGGGTGACTACCAGAAAGCCATTGAAGATTATCAAAAGGCTTTGGAATTGGATCCTAAC
AACAGATCTAGATCAGCTGGTGGTGGTGGTTCTGGTGGTGGTGGTTCTGGTGGTGGTGGTGCTT
CTTCATATTACCATCACCATCACCATCACTTGGAATCCACAAGTTTATACAAAAAGGCTGGTTCTG
GTTCAAATTTGGTCGCACAATTGGAAAACGAAGTAGCCTCTTTAGAAAATGAAAACGAAACCTTG
AAAAAGAAAAACTTACATAAGAAAGATTTGATCGCTTATTTGGAAAAGGAAATCGCAAATTTGAGA
AAGAAAATTGAAGAAGGTAGTGCAGGTTCTGCCGCTGGTTCTGGTGAATTTGGTTCAGCTGAAG
CAGCCGCTAAGGAAGCAGCCGCTAAAGCCGGTTCAGCTGGTTCCGCAGCCGGTTCTGGTGAAT
TCGGTTCCAGTTACTATCACCATCACCATCATCACTTGGAATCCACAAGTTTATATAAGAAAGCAG
GTTCTGGTTCAGCAAGAAATGCCTACTTGAGAAAGAAATAGCTAGATTAAAGAAAGATAACTTG
CAATTGGAAAGAGATGAACAAAATTTGGAAAAGATTATCGCCAACTTAAGAGATGAAATCGCTAG
ATTGGAAAATGAAGTTGCATCCCATGAACAAGGTAGTGGTGCTACTAACTTCTCTTTGTTGAAGC
AAGCAGGTGACGTTGAAGAAAATCCAGGTCCAATGAAAAACTGTGTAATCGTTTCTGCTGTTAGA
ACTGCAATTGGTTCCTTTAATGGTAGTTTGGCCTCTACATCAGCTATTGATTTGGGTGCTACCGT
CATCAAAGCTGCAATTGAAAGAGCAAAGATTGATTCTCAACATGTCGACGAAGTAATAATGGGTA
ACGTTTTGCAAGCTGGTTTAGGTCAAAATCCAGCAAGACAAGCCTTGTTAAAATCTGGTTTAGCA
```

Figure 15E (continued)

```
GAAACTGTATGTGGTTTCACAGTTAATAAGGTCTGCGGTTCTGGTTTGAAGTCAGTTGCTTTAGC
CGCTCAAGCTATACAAGCAGGTCAAGCCCAATCTATCGTCGCTGGTGGTATGGAAAATATGTCAT
TGGCACCTTATTTGTTAGATGCAAAAGCCAGATCAGGTTATAGATTAGGTGACGGTCAAGTATAC
GACGTTATTTTGAGAGATGGTTTAATGTGCGCTACTCATGGTTATCACATGGGTATTACAGCAGA
AAATGTTGCCAAAGAATACGGTATAACCAGAGAAATGCAAGATGAATTGGCATTACATTCCCAAA
GAAAGGCAGCCGCTGCAATCGAAAGTGGTGCTTTTACTGCAGAAATTGTCCCAGTAAACGTTGT
CACAAGAAAGAAAACTTTCGTTTTCTCCCAAGATGAATTCCCAAAAGCTAATAGTACCGCTGAAG
CATTGGGTGCTTTAAGACCTGCATTCGACAAGGCCGGTACCGTAACTGCCGGTAATGCTTCTGG
TATAAACGATGGTGCCGCTGCATTGGTTATCATGGAAGAATCAGCCGCTTTAGCAGCCGGTTTG
ACACCTTTAGCTAGAATTAAATCTTATGCATCAGGTGGTGTTCCACCTGCTTTGATGGGTATGGG
TCCAGTCCTGCTACCCAAAAGGCATTGCAATTAGCCGGTTTGCAATTGGCTGATATCGACTTAA
TCGAAGCAAACGAAGCCTTTGCTGCACAATTCTTGGCAGTTGGTAAAAATTTGGGTTTCGACTCC
GAAAAGGTTAATGTCAACGGTGGTGCCATTGCTTTGGGTCATCCAATAGGTGCTTCAGGTGCAA
GAATCTTGGTTACATTGTTGCATGCCATGCAAGCTAGAGATAAAACCTTGGGTTTAGCTACTTTGT
GTATCGGTGGTGGTCAAGGTATCGCAATGGTTATCGAAAGATTGAATAAGTTGTCTGGTGGTGG
TGGTTCTGGTGGTGGTGGTTCTGGTGGTGGTGGTAGTGCAGAAGCCTGGTACAATTTGGGTAAC
GCTTACTACAAGCAGGGTGACTACCAAAAGGCAATCGAATACTACCAAAAGGCCTTGGAATTAG
ATCCAAATAACGCTGAAGCATGGTATAATTTGGGTAATGCCTATTATAAACAGGGTGACTATCAA
AAAGCTATTGAATATTACCAAAAGGCATTGGAATTAGATCCTAATAACGCCGAAGCTTGGTATAAT
TTGGGTAACGCCTATTATAAGCAGGGTGACTATCAAAAGGCCATCGAAGATTACCAAAAGGCTTT
GGAATTGGATCCAAACAACTTGCAAGCAGAAGCCTGGAAGAATTTGGGTAACGCTTATTACAAAC
AGGGTGACTACCAAAAAGCTATTGAATACTATCAAAAAGCCTTAGAATTGGATCCTAATAACGCTT
CTGCATGGTACAATTTGGGTAATGCCTACTATAAACAGGGTGACTACCAGAAGGCTATTGAATAC
TACCAAAAAGCATTAGAATTGGATCCAAATAACGCCAAGGCTTGGTACAGACGTGGTAATGCCTA
TTACAAGCAGGGTGACTACCAGAAAGCCATAGAAGACTATCAAAAAGCCTTGGAATTGGATCCTA
ACAACAGATCCAGAAGTGCTGGTGGTGGTGGTTCTGGTGGTGGTGGTTCTGGTGGTGGTGGTG
CTTCTTCATATTACCATCACCATCACCATCACTTGGAATCTACATCATTATACAAAAAGGCTGGTT
CCGGTAGTAATGAAGTTACTACATTGGAAAACGATGCCGCTTTTATCGAAAACGAAAACGCATAC
TTGGAAAAGGAAATCGCCAGATTAAGAAAGGAAAAGGCAGCCTTGAGAAATAGATTAGCCCATA
AAAAGGGTTCCGCTGGTAGTGCTGCAGGTTCTGGTGAATTTGGTTCAGCTGAAGCCGCTGCAAA
AGAAGCCGCTGCAAAGGCAGGTTCTGCCGGTTCAGCCGCTGGTTCTGGTGAATTCGGTTCCAGT
TACTATCACCATCACCATCATCACTTGGAATCTACTTCATTATATAAAAAGGCCGGTTCCGGTAGT
CAAAAAGTCGCTGAATTAAAGAACAGAGTAGCTGTTAAGTTGAACAGAAACGAACAATTGAAAAA
TAAGGTAGAAGAATTGAAAAATAGAAACGCCTACTTAAAGAATGAATTGGCAACATTGGAAAACG
AAGTCGCTAGATTGGAAAATGATGTAGCAGAAGGTTCTGGT
```

Description:
MCS:            1 – 40 bp
AmpRpromoter:   536 – 640 bp
AmpR:           641 – 1501 bp
Ori:            1672 – 2260 bp
pUCLINK:        2681 – 5424 bp Total Cannabinoids Precursors + Specific Cannabinoids Acidic + Decarboxy Cannabinoids

BIDIRECTIONAL MULTI-ENZYMATIC SCAFFOLDS FOR BIOSYNTHESIZING CANNABINOIDS

CROSS-REFERENCE TO RELATED APPLICATIONS

This application claims priority to U.S. Application Ser. No. 62/836,265, filed on Apr. 19, 2019 and 62/771,839, filed on Nov. 27, 2018. The disclosures of the prior applications are considered part of the disclosure of this application, and are incorporated in their entirety into this application.

TECHNICAL FIELD

This document relates to methods and materials for biosynthesizing cannabinoids, and more particularly to using bidirectional multi-enzymatic scaffolds to biosynthesize cannabinoids.

BACKGROUND

The emerging therapeutic potential of cannabinoids warrants industrial-scale production to meet compounding future demands. Traditional cannabinoid production efforts rely on large-scale farming of *Cannabis sativa* L. However, agricultural cannabinoid production is problematic due to issues such as uncontrollable environmental factors and scaling limitations.

SUMMARY

This document is based, at least in part, on the discovery that a bidirectional, multi-enzymatic scaffold can be engineered to allow high-throughput cannabinoid production in recombinant host cells. By controlling the localization, spatial orientation, and stoichiometry of enzymes catalyzing the biosynthesis of cannabinoids and cannabinoid precursors, the multi-enzymatic scaffolds described herein allow flux-optimized cannabinoid biosynthesis in genetically-engineered host cells.

In one aspect, this document features a host cell capable of producing one or more cannabinoids selected from the group consisting of cannabigerolic acid, cannabidiolic acid, and cannabichromenic acid. The host cell includes at least three different exogenous nucleic acids, wherein the first and the second exogenous nucleic acids each encode a plurality of engineered enzymes selected from the group consisting of acetyl-CoA acetyltransferase, a 3-hydroxybutyryl-CoA dehydrogenase, an enoyl-CoA hydratase, a beto-ketothiolase, a trans-enoyl-CoA reductase, an HMG-CoA synthetase, an HMG-CoA reductase, a mevalonate kinase, a phosphomevalonate kinase, a diphosphomevalonate decarboxylase, an isopentenyl-diphosphate delta isomerase, a geranyl-diphosphate synthase, an olivetol synthase, an olivetolic acid cyclase, and a CBGA synthase; wherein each of the engineered enzymes includes a heterologous interaction domain, wherein the heterologous interaction domain comprises a first and a second peptide motif, and wherein each heterologous interaction domain is different from each other; and wherein the third exogenous nucleic acid encodes a polypeptide scaffold comprising a plurality of peptide ligands, wherein each peptide ligand comprises an amino acid sequence that can bind to the first or the second peptide motif of one of the heterologous interaction domains. The plurality of engineered enzymes further can include an ATP citrate lyase and an acetyl-CoA carboxylase. The host cell further can include an exogenous nucleic acid encoding a cannabidiolic acid synthase (CBDAS) and a cannabichromenic acid synthase (CBCAS). The host cell can include an exogenous CBDAS. The host cell can include an exogenous CBCAS. The host cell can include an exogenous CBDAS and an exogenous CBCAS. The host cell can include an exogenous hexanoyl-CoA synthetase. The host cell can include at least four different exogenous nucleic acids, wherein the first, second, and fourth nucleic acids each encode a plurality of the engineered enzymes. The host cell can include at least five different exogenous nucleic acids, wherein the first, second, fourth, and fifth nucleic acid each encode a plurality of the engineered enzymes. The host cell can include at least six different exogenous nucleic acids, wherein the first, second, fourth, fifth, and sixth nucleic acids each encode a plurality of the engineered enzymes. Each exogenous nucleic acid can include a constitutive promoter operably linked to the sequence encoding the engineered enzyme or polypeptide scaffold or an inducible promoter operably linked to the sequence encoding the engineered enzyme or polypeptide scaffold. In some embodiments, the promoter is a GAL1-10 promoter. In some embodiments, a constitutive promoter used to express the polypeptide scaffold has weaker constitutive activity level than a constitutive promoter used to express the engineered enzymes. In some embodiments, a constitutive promoter is used to express the engineered enzymes and an inducible promoter is used to express the polypeptide scaffold. In some embodiments, an inducible promoter is used to express the engineered enzymes and a constitutive promoter is used to express the polypeptide scaffold.

Any of the host cells can be bacterial, yeast, algae, or plant cells. A bacterial cell can be selected from the group consisting of *Escherichia coli, Bacillus, Brevibacterium, Streptomyces,* and *Pseudomonas* cells. A yeast cell can be selected from the group consisting of *Pichia pastoris, Saccharomyces cerevisiae, Yarrowia lipolytica, Kluyveromyvces marxianus,* and *Komagataella phaffi* cells. An algae cell can be *Dunaliella* sp., *Chlorella variabilis, Euglena mutabilis,* or *Chlamydomonas reinhardtii* cells. A plant cell can be a *Cannabis* or tobacco cell.

In some embodiments, each of the engineered enzymes is of the formula: enzyme-linker$_1$-spacer-linker$_2$-motif$_1$-linker$_3$-motif$_2$, where linkers 1, 2, and 3 can be the same or different, motif 1 and motif 2 can be the same or different, and where motif 1 and motif 2 form the heterologous interaction domain. A scaffold polypeptide can be of the formula: N-terminus-[Ligand 1-linker-Ligand 2-Spacer]n-(optionally-tagged)C-terminus, where n is the number of heterologous interaction domains, and where ligand 1 and ligand 2 bind motif 1 and motif 2, respectively, of the heterologous interaction domain. The scaffold polypeptide can be tagged with a MYC tag, FLAG tag, or HA tag. The host cell further can include a nucleic acid encoding a second polypeptide scaffold comprising a plurality of peptide ligands, wherein each peptide ligand comprises an amino acid sequence that can bind to a different motif of the heterologous interaction domain. The linker can have a flexible GS-rich sequence flanking a rigid α-helical moiety. The spacer can be the cTPR6 spacer.

This document also features a method of producing one or more cannabinoids selected from the group consisting of cannabigerolic acid, cannabidiolic acid, and cannabichromenic acid. The method can include culturing any of the host cells described herein under conditions wherein the host cell produces the one or more cannabinoids. The host cells can be cultured in a culture medium supplemented with citrate, glucose, hexanoic acid, and/or other carbon source, and/or in a culture medium supplemented with malonyl-CoA. The method further can include extracting the one or more cannabinoids from the host cells.

Unless otherwise defined, all technical and scientific terms used herein have the same meaning as commonly understood by one of ordinary skill in the art to which this invention pertains. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Other features and advantages of the invention will be apparent from the following detailed description, and from the claims.

DESCRIPTION OF DRAWINGS

FIG. 6A contains the amino acid sequence of each of the following enzymes: an ATP citrate lyase (SEQ ID NO:83), acetyl-CoA acetyltransferase (atoB) (SEQ ID NO:84), a 3-hydroxybutyryl-CoA dehydrogenase (SEQ ID NO:85), an enoyl-CoA hydratase (SEQ ID NO:86), a trans-enoyl-CoA reductase (SEQ ID NO:88), a beta-ketothiolase (bktB) (SEQ ID NO:87), an HMG-CoA synthase (SEQ ID NO:90), a truncated HMG-CoA reductase (SEQ ID NO:91), a mevalonate kinase (SEQ ID NO:92), a phosphomevalonate kinase (SEQ ID NO:93), a diphosphomevalonate decarboxylase (SEQ ID NO:94), an isopentenyl-diphosphate delta isomerase (SEQ ID NO:95), a mutant geranyl-diphosphate synthase (ERG20$^{WW}$) (SEQ ID NO:96), an olivetol synthase (SEQ ID NO:98), an olivetolic acid cyclase (SEQ ID NO:99), a CBGA synthase (SEQ ID NO: 100), an acetyl-CoA carboxylase (SEQ ID NO:97), a CBDA synthase (SEQ ID NO:101), a CBCA synthase (SEQ ID NO:102), and a hexanoyl-CoA synthetase (SEQ ID NO:89).

FIG. 6B contains the amino acid sequence of engineered enzymes of the formula Enzyme-Enzyme Linker-cTPR6 Spacer-ID Linker-ID Motif #1-ID Motif Linker-ID Motif #2, where the linkers (enzyme linker, ID linker, and ID motif linker) can be the same or different, and ID motif #1 and ID motif #2 can be the same or different. The amino acid sequence of the following engineered enzymes are provided: ATP citrate lyase (ID1) (SEQ ID NO: 103), an acetyl-CoA acetyltransferase (atoB) (ID2) (SEQ ID NO: 104), a 3-hydroxybutyryl-CoA dehydrogenase (ID3) (SEQ ID NO: 105), an enoyl-CoA hydratase (ID4) (SEQ ID NO:106), a trans-enoyl-CoA reductase (ID5) (SEQ ID NO: 107), a beto-ketothiolase (bktB) (ID6) (SEQ ID NO: 108), an HMG-CoA synthase (ID7) (SEQ ID NO: 109), a truncated HMG-CoA reductase (ID8) (SEQ ID NO: 110), a mevalonate kinase (ID9) (SEQ ID NO: 111), a phosphomevalonate kinase (ID10) (SEQ ID NO: 112), a diphosphomevalonate decarboxylase (ID11) (SEQ ID NO: 113), an isopentenyl-diphosphate delta isomerase (ID12) (SEQ ID NO:114), a mutant geranyl-diphosphate synthase (ERG20$^{WW}$) (ID13) (SEQ ID NO: 115), an olivetol synthase (ID14) (SEQ ID NO:116), an olivetolic acid cyclase (ID15) (SEQ ID NO:117), a CBGA synthase (ID16) (SEQ ID NO: 118), and an acetyl-CoA carboxylase (ID17) (SEQ ID NO:211).

FIG. 6C contains the amino acid sequence of a polypeptide scaffold of the formula: N-terminus-[Ligand #1-ID Motif #1 Ligand-Linker-ID Motif #2 Ligand-Scaffolded ID-binding Site Spacer]n-(Myc)3-tagged C-terminus, where n is 16 and the ID motif ligands correspond to the motifs for IDs 1-16 as shown in Table 2. See SEQ ID NO: 119.

FIG. 6D contains the amino acid sequence of a polypeptide scaffold of the formula: N-terminus-[Ligand #1-ID Motif #1 Ligand-Linker-ID Motif #2 Ligand-Scaffolded ID-binding Site Spacer]n-(FLAG)3-tagged C-terminus, where n is 2 and the ID motif ligands correspond to the motifs for IDs 1 and 17 as shown in Table 2. See SEQ ID NO:120.

FIG. 12A contains the nucleotide sequences encoding each of the following: an ATP citrate lyase (SEQ ID NO:121), an acetyl-CoA acetyltransferase (atoB) (SEQ ID NO: 122), a 3-hydroxybutyryl-CoA dehydrogenase (SEQ ID NO: 123), an enoyl-CoA hydratase (SEQ ID NO: 124), a trans-enoyl-CoA reductase (SEQ ID NO: 125), a beto-ketothiolase (bktB) (SEQ ID NO: 126), an HMG-CoA synthase (SEQ ID NO: 127), a truncated HMG-CoA reductase (SEQ ID NO: 128), a mevalonate kinase (SEQ ID NO: 129), a phosphomevalonate kinase (SEQ ID NO: 130), a diphosphomevalonate decarboxylase (SEQ ID NO: 131), an isopentenyl-diphosphate delta isomerase (SEQ ID NO: 132), a geranyl-diphosphate synthase (ERG20$^{WW}$) (SEQ ID NO: 133), an olivetol synthase (SEQ ID NO: 134), an olivetolic acid cyclase (SEQ ID NO: 135), a CBGA synthase (SEQ ID NO: 136), an acetyl-CoA carboxylase (SEQ ID NO: 137), a CBDA synthase (SEQ ID NO: 138), a CBCA synthase (SEQ ID NO: 139), and a hexanoyl-CoA synthetase (SEQ ID NO: 140).

FIG. 12B contains the nucleotide sequences encoding engineered enzymes of the formula: Enzyme-Enzyme Linker-cTPR6 Spacer-ID Linker-ID Motif #1-ID Motif Linker-ID Motif #2, where the Enzyme Linker, ID Linker, and ID Motif Linker can be the same or different, and where ID Motif #1 and ID Motif #2 can be the same or different. The nucleotide sequences encoding the following engineered enzymes are provided: ATP citrate lyase (ID1) (SEQ ID NO: 141), an acetyl-CoA acetyltransferase (atoB) (ID2) (SEQ ID NO: 142), a 3-hydroxybutyryl-CoA dehydrogenase (ID3) (SEQ ID NO: 143), an enoyl-CoA hydratase (ID4)

Figure 1A:
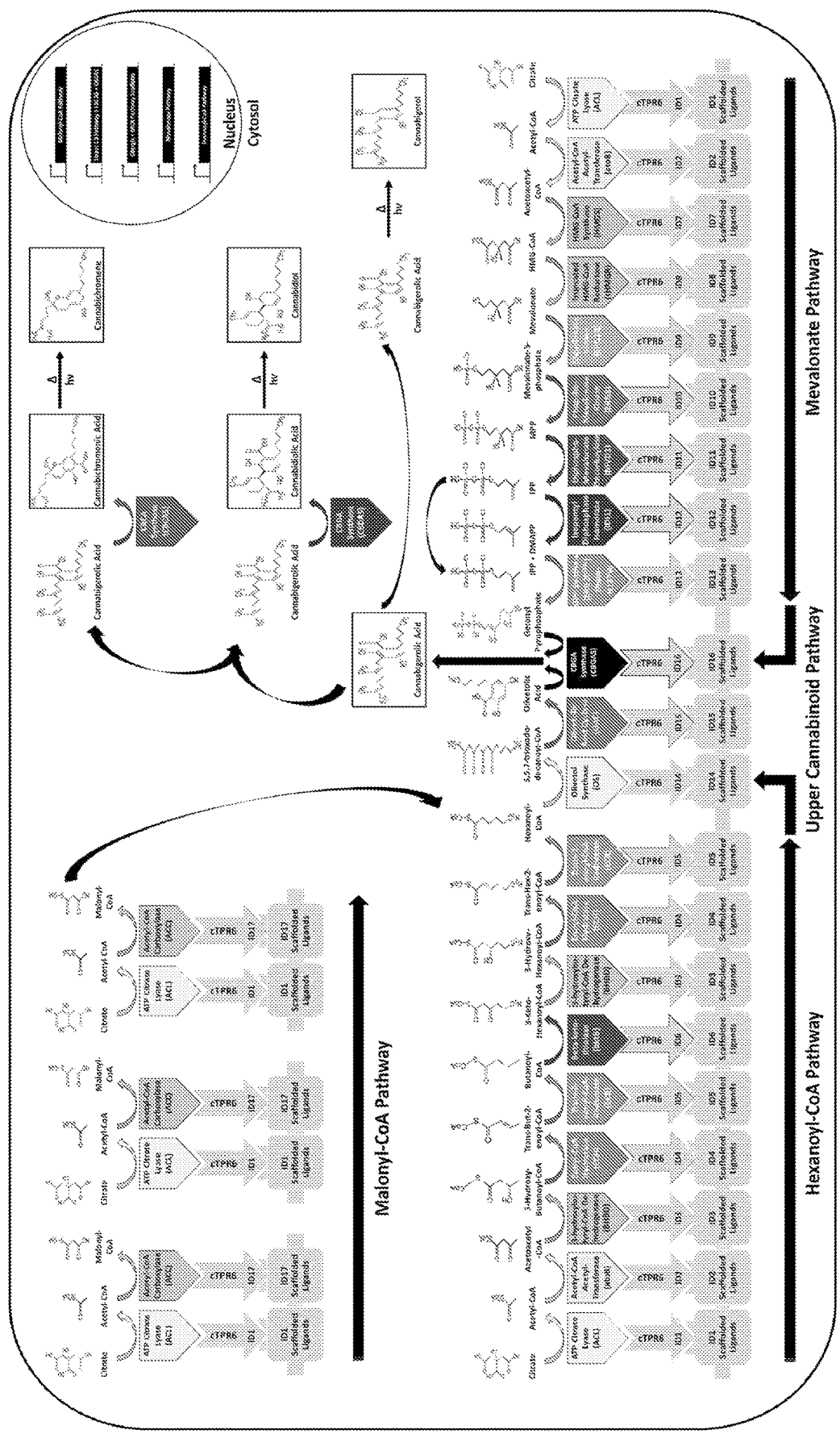
FIG. 1A is a schematic of one representative embodiment of a multi-enzymatic cannabinoidergic scaffold within a cell. The multi-enzymatic scaffold includes enzymes of the hexanoyl-CoA pathway, enzymes of the upper cannabinoid pathway, and enzymes of the mevalonate pathway. The schematic also depicts a second scaffold according to one embodiment containing enzymes of the malonyl-CoA pathway and depicts a non-scaffolded cannabidiolic acid synthase (CBDAS) and a non-scaffolded cannabichromenic acid synthase (CBCAS). ID refers to enzyme-linked interaction domain, cTPR6 refers to a spacer sequence, scaffolded ligands refer to the tandem peptide ligands that form the scaffold-binding sites specific for each enzyme-linked ID. The target products cannabigerolic acid (CBGA), cannabigerol (CBG), cannabidiolic acid (CBDA), cannabidiol (CBD), cannabichromenic acid (CBCA), and cannabichromene (CBC), are boxed for emphasis. CBG can be produced by decarboxylation of CBGA, CBD can be produced by decarboxylation of CBDA, and CBC can be produced by decarboxylation of CBCA. For each decarboxylation, the 'Δ' symbols represent heat and the 'hv' symbols represent light.

(SEQ ID NO: 144), a trans-enoyl-CoA reductase (ID5) (SEQ ID NO: 145), a bktB (ID6) (SEQ ID NO: 146), an HMG-CoA synthase (ID7) (SEQ ID NO: 147), a truncated HMG-CoA reductase (ID8) (SEQ ID NO: 148), a mevalonate kinase (ID9) (SEQ ID NO: 149), a phosphomevalonate kinase (ID10) (SEQ ID NO: 150), a diphosphomevalonate decarboxylase (ID11) (SEQ ID NO: 151), an isopentenyl-diphosphate delta isomerase (ID12) (SEQ ID NO: 152), a mutant geranyl-diphosphate synthase (ERG20$^{WW}$) (ID13) (SEQ ID NO: 153), an olivetol synthase (ID14) (SEQ ID NO:154), an olivetolic acid cyclase (ID15) (SEQ ID NO:155), a CBGA synthase (ID16) (SEQ ID NO: 156), and an acetyl-CoA carboxylase (ID17) (SEQ ID NO: 157).

FIG. 12C contains the nucleotide sequence (SEQ ID NO: 158) encoding a scaffold polypeptide that contains the peptide ligands corresponding to IDs 1-16 as shown in Table 2 and a triplicate myc tag on the C-terminus.

FIG. 12D contains the nucleic acid sequence (SEQ ID NO: 159) encoding a scaffold polypeptide that contains the peptide ligands corresponding to IDs 1 and 17, and a triplicate FLAG tag on the C-terminus.

FIG. 13A contains the amino acid sequence of scaffold-binding engineered enzymes and a soluble hexanoyl-CoA synthetase (HCS) (SEQ ID NO:209) encoded by the HCA gene cassette. The scaffold-binding engineered enzymes are ATP Citrate Lyase (ACL) (ACL-Enzyme Linker-cTPR6 Spacer-ID Linker-ID1) (SEQ ID NO: 160); Acetyl-CoA Acetyltransferase (atoB) (atoB-Enzyme Linker-cTPR6 Spacer-ID Linker-ID2) (SEQ ID NO: 161); 3-Hydroxybutyryl-CoA Dehydrogenase (BHBD) (BHBD-Enzyme Linker-cTPR6 Spacer-ID Linker-ID3) (SEQ ID NO:162); Enoyl-CoA Hydratase (ECH) (ECH-Enzyme Linker-cTPR6 Spacer-ID Linker-ID4) (SEQ ID NO: 163); Trans-Enoyl-CoA Reductase (ECR) (ECR-Enzyme Linker-cTPR6 Spacer-ID Linker-ID5) (SEQ ID NO: 164); and Beta-Keto-thiolase (bktB) (bktB-Enzyme Linker-cTPR6 Spacer-ID Linker-ID6) (SEQ ID NO: 165).

FIG. 13B contains the amino acid sequences of scaffold-binding engineered enzymes encoded by the GPP gene cassette. The scaffold-binding engineered enzymes are HMG-CoA Synthase (HMGS) (HMGS-Enzyme Linker-cTPR6 Spacer-ID Linker-ID7) (SEQ ID NO: 166); truncated HMG-CoA Reductase (tHMGR) (tHMGR-Enzyme Linker-cTPR6 Spacer-ID Linker-ID8) (SEQ ID NO: 167); Mevalonate Kinase (ERG12) (ERG12-Enzyme Linker-cTPR6 Spacer-ID Linker-ID9) (SEQ ID NO: 168); Phosphomevalonate Kinase (ERG8) (ERG8-Enzyme Linker-cTPR6 Spacer-ID Linker-ID10) (SEQ ID NO: 169); Diphosphomevalonate Decarboxylase (MVD1) (MVD1-Enzyme Linker-cTPR6 Spacer-ID Linker-ID11) (SEQ ID NO: 170); Isopentenyl-Diphosphate Delta-Isomerase (IDI1) (IDI1-Enzyme Linker-cTPR6 Spacer-ID Linker-ID12) (SEQ ID NO: 171); and Geranyl-Diphosphate Synthase (ERG20WW) (ERG20WW-Enzyme Linker-cTPR6 Spacer-ID Linker-ID13) (SEQ ID NO:172).

FIG. 13C contains the amino acid sequences of scaffold-binding engineered enzymes, a soluble CBDA synthase (SEQ ID NO: 173), and a soluble CBCA synthase (SEQ ID NO: 174) encoded by the CAN gene cassette. The scaffold-binding engineered enzymes are Olivetol Synthase (OS) (OS-Enzyme Linker-cTPR6 Spacer-ID Linker-ID14) SEQ ID NO: 175); Olivetolic Acid Cyclase (OAC) (OAC-Enzyme Linker-cTPR6 Spacer-ID Linker-ID15) (SEQ ID NO: 176); CBGA Synthase (CBGAS-Enzyme Linker-cTPR6 Spacer-ID Linker-ID16) (SEQ ID NO: 177); and Acetyl-CoA Carboxylase (ACC) (ACC-Enzyme Linker-cTPR6 Spacer-ID Linker-ID17) (SEQ ID NO:178).

FIG. 13D contains the amino acid sequences of the Cannabinoidergic Metabolon Scaffold (CBSCFLD)-(Myc)3 (SEQ ID NO: 179) and the Malonyl-CoA Metabolon Scaffold (MCASCFLD)-(FLAG)$_3$ (SEQ ID NO: 180).

FIG. 14A contains codon-optimized nucleotide sequences (SEQ ID NOs: 181-187) encoding the enzymes of FIG. 13A.

FIG. 14B contains the codon-optimized nucleotide sequences (SEQ ID NOs:188-194) encoding the enzymes of FIG. 13B.

FIG. 14C contains the codon-optimized nucleotide sequences (SEQ ID NOs: 195-200) encoding the enzymes of FIG. 13C.

FIG. 14D contains the codon-optimized nucleotide sequences (SEQ ID NO:201 and SEQ ID NO:202) encoding the scaffolds of FIG. 13D.

FIG. 15A contains the nucleotide sequence of the HCA gene cassette (SEQ ID NO:203).

FIG. 15B contains the nucleotide sequence of the GPP gene cassette (SEQ ID NO:204).

FIG. 15C contains the nucleotide sequence of the CAN gene cassette (SEQ ID NO:205).

FIG. 15D contains the nucleotide sequence of the SCF gene cassette (SEQ ID NO:206).

FIG. 15E contains the nucleotide sequence of the SOL gene cassette (SEQ ID NO:207).

Figure 16:
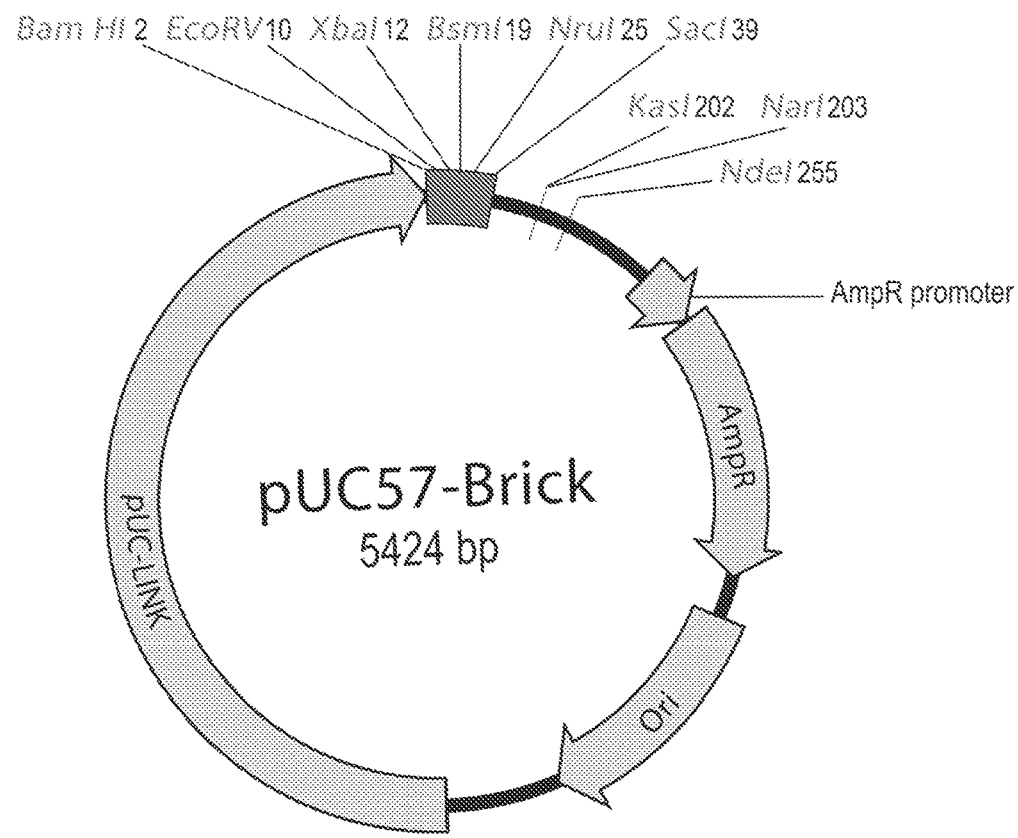

FIG. 16 is a map of the pCCI-Brick plasmid construct.

Figure 17:
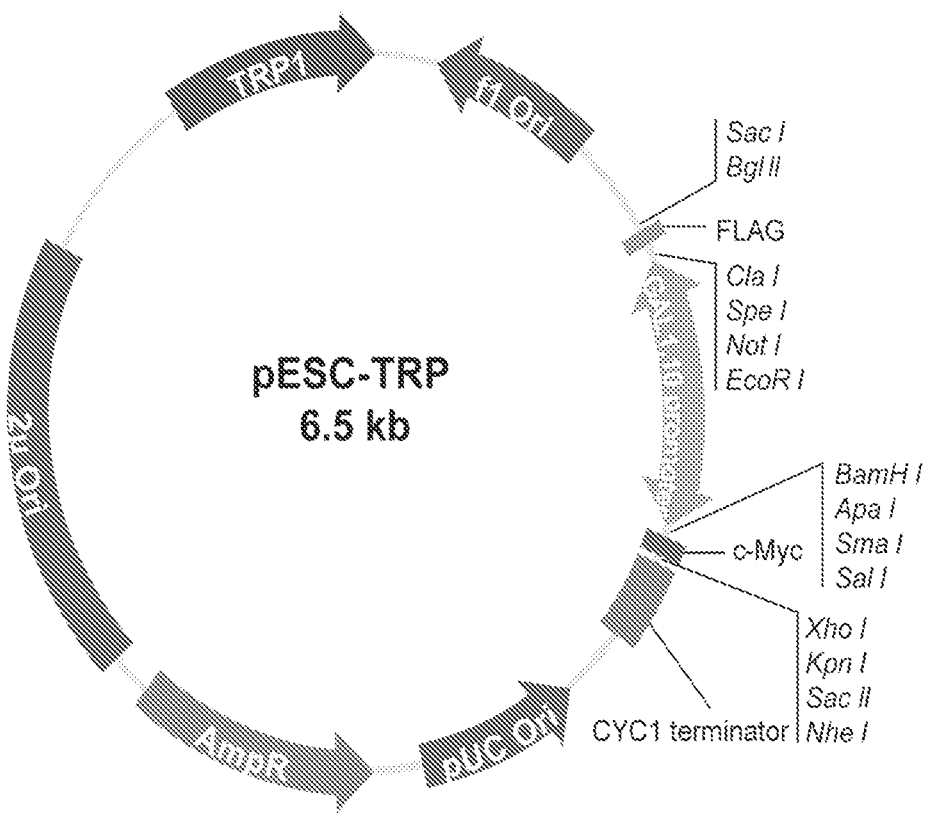

FIG. 17 is a map of a pESC-TRP ("vHCA") vector construct. In this map, the vector contains a TRP gene allowing selection in tryptophan deficient media. Similar vectors also were made in which the TRP gene was replaced with a LEU gene allowing selection in leucine deficient media, a HIS3 gene allowing selection in histidine deficient media, or a URA3 gene allowing selection in uracil deficient media.

Figure 18:
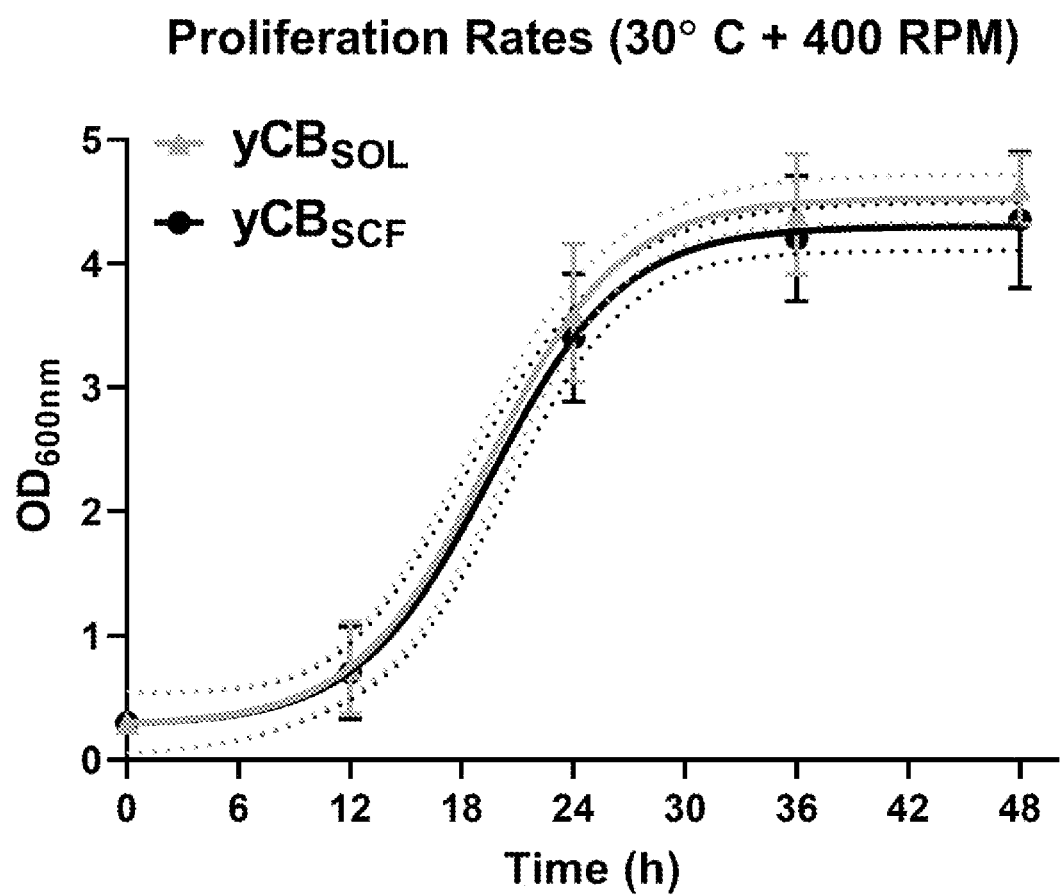
Figures 19A, 19B:
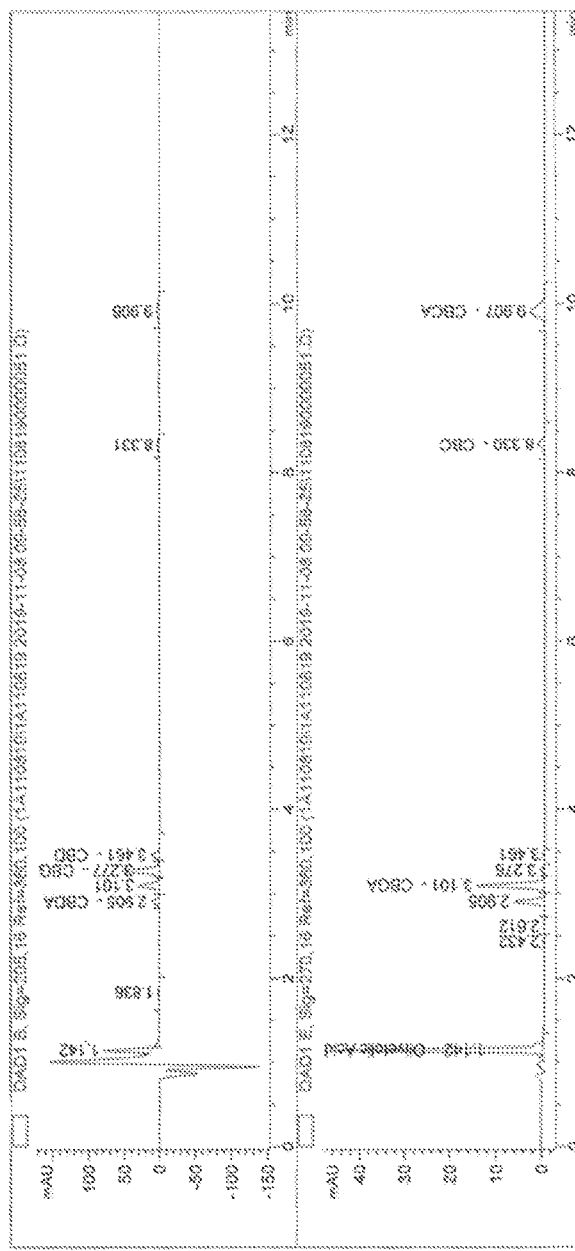
Figure 19C:
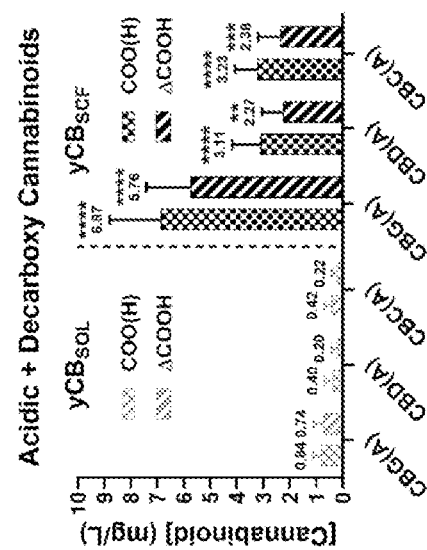
Figure 19D:
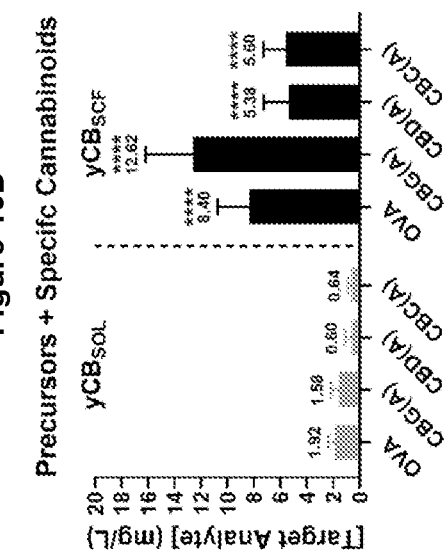
Figure 19E:
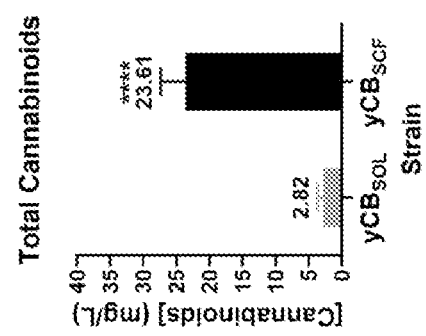

FIG. 18 is a graph of the proliferation curves for yCBSCF and yCBSOL cultures. Line plots depicting cell proliferation curves were fitted via nonlinear regression of cell density measurements (OD$_{600nm}$) recorded in 12-hour intervals over a 48-hour incubation period for yCBSCF and yCBSOL cultures. Initial cell densities for all cultures were standardized to OD$_{600nm}$=0.3. For all measures, n=3 biological replicates for yCBSCF and yCBSOL cultures. Floating data points depict means with 95% confidence intervals. Dotted lines represent 95% confidence intervals for regression curve fits.

FIG. 19 shows a comparison of cannabinoid and precursor titers for scaffolded and soluble cannabinoid biosynthesis. Representative mass spectra of target analytes isolated from (A) yCBSOL and (B) yCBSCF cultures incubated for 48 hours in basal culture media. Bar plots depicting (C) Total (aggregate) cannabinoid (CBGA+CBDA+CBCA+CBG+CBD+CBC) titers, (D) cannabinoid precursor (OVA) titers and summated parent and decarboxylation derivative (CBGA+CBG CBDA+CBD, and CBCA+CBC) cannabinoid titers, and (E) separated parent (COO(H)) cannabinoid (CBGA, CBDA, and CBCA) and decarboxylation derivative (ΔCOOH) cannabinoid (CBG, CBD, and CBC) titers for 48-hour yCBSOL (left) and yCBSCF (right) cultures grown in basal culture media. For all measures, n=3 biological replicates for yCBSCF and yCBSOL cultures. CB, cannabinoid; Cannabigerolic acid, CBGA; cannabigerol, CBG; cannabidiolic acid, CBDA; cannabidiol, CBD; cannabichromenic acid, CBCA; cannabichromene, CBC, olivetolic acid, OVA. Floating asterisks indicate statistically significant (determined by Bonferroni's multiple comparisons post-hoc test; α=0.05) between-strain differences for yCB- SCF versus yCBSOL cultures. Bar plots depict means with 95% confidence intervals. *p<0.05; p<0.0 *p<1; *p<0.001; **p<0.0001.

Figure 20:
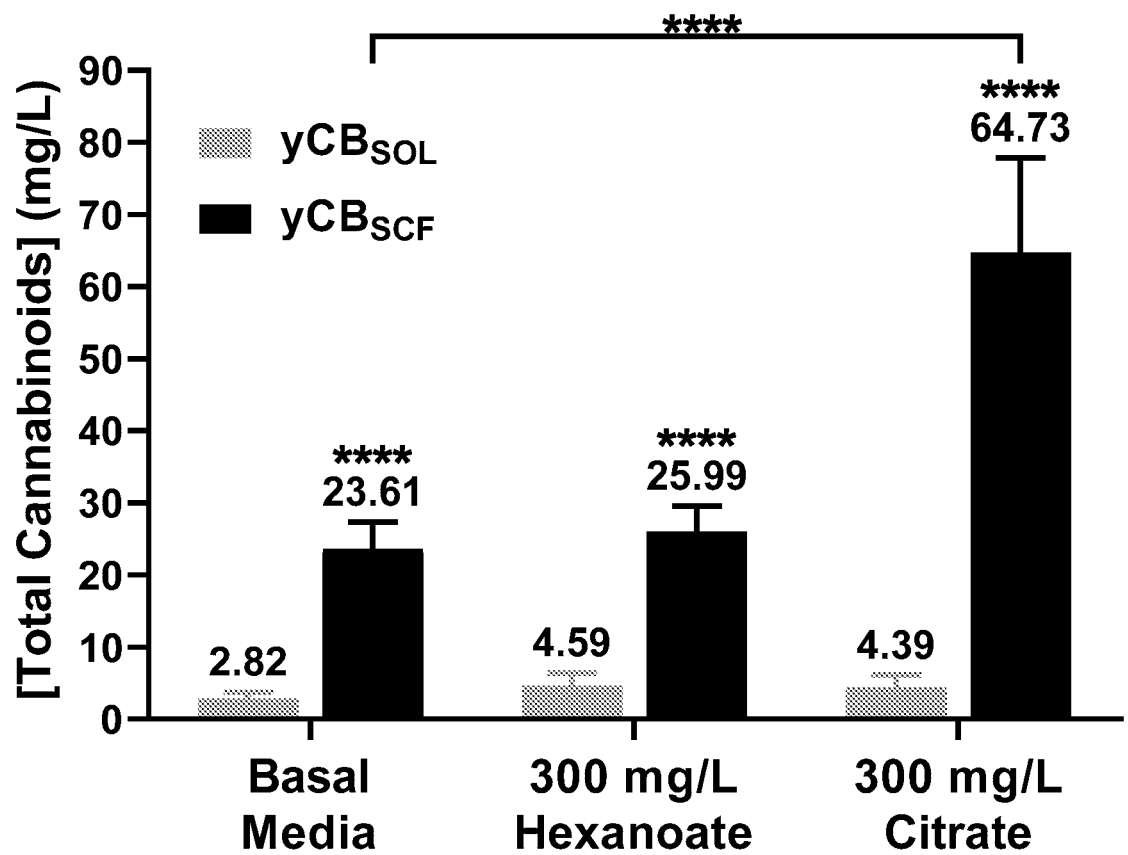

FIG. 20 is a bar plot of the impact of citrate and hexanoate supplementation on scaffolded and soluble cannabinoid biosynthesis. Total cannabinoid (CBGA+CBDA+CBCA+CBG+CBD+CBC) titers are shown for yCBSOL and yCBSCF cultures incubated for 48 hours in basal, hexanoate (300 mg/L)-supplemented, and buffered (pH 6.0) citrate (300 mg/L)-supplemented culture media. Floating asterisks indicate statistically significant (determined by Bonferroni's multiple comparisons post-hoc test; a=0.05) between-strain differences for yCBSCF versus yCBSOL cultures. Lines with asterisks indicate statistically significant (determined by Bonferroni's multiple comparisons post-hoc test; α=0.05) within-strain differences for basal media total cannabinoid titers versus citrate-supplemented media total cannabinoid titers for yCBSCF cultures. Bar plots depict means with 95% confidence intervals. *p<0.05; p<0.01; *p<0.001; ****p<0.0001.

Figure 21A:
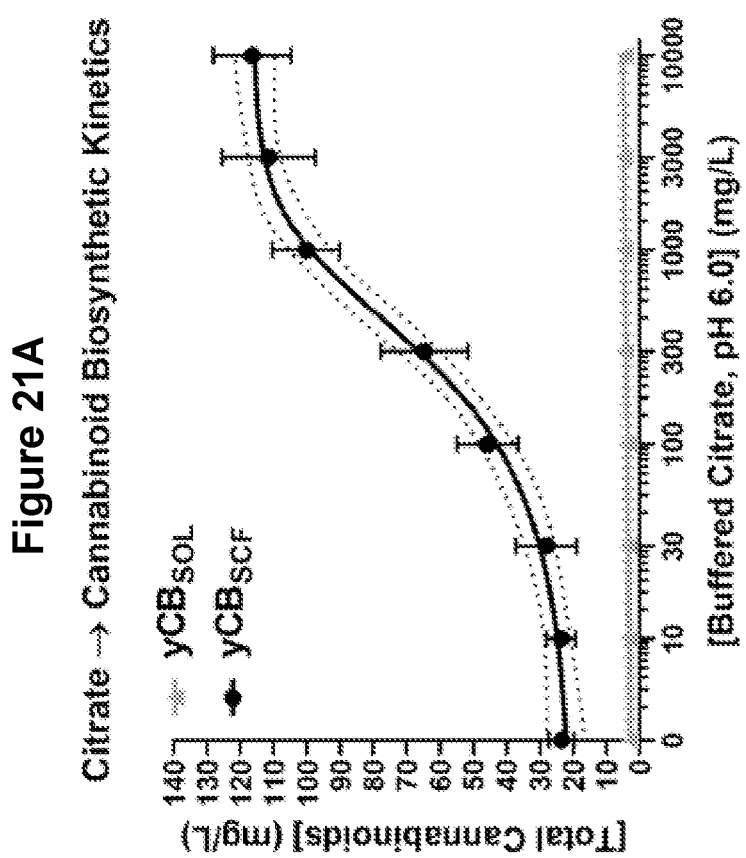
Figure 21B:
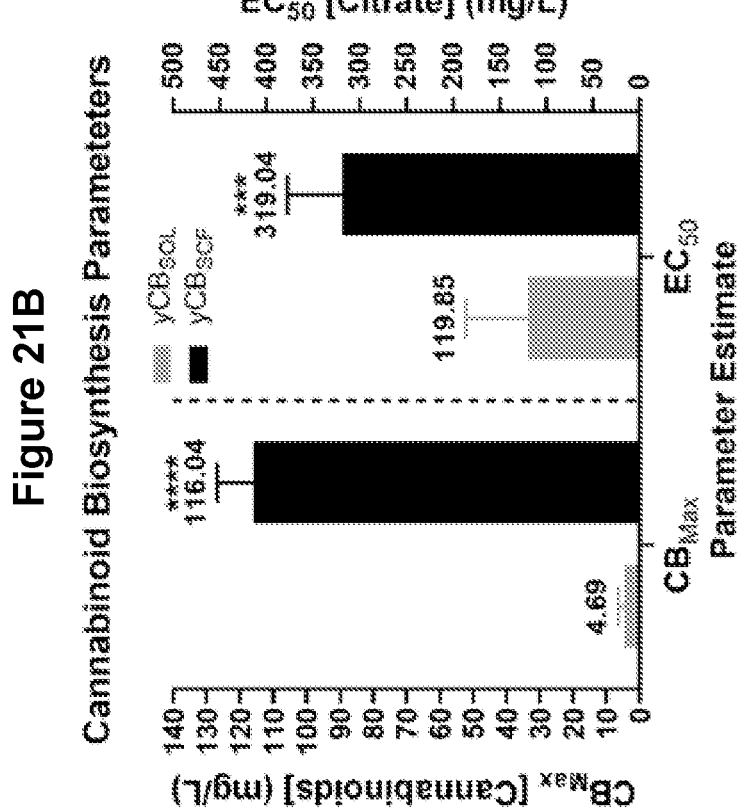

FIG. 21 shows concentration-response parameterization of scaffolded and soluble cannabinoid biosynthesis from citrate. In FIG. 21A, line plots are shown depicting eight-point concentration ([citrate])-response (total cannabinoid titers) curves fitted via asymmetric sigmoidal (five-parameter) logistic regression and in FIG. 21B, bar graphs are shown depicting concentration-response parameter estimates ($CB_{Max}$, the estimated maximum total cannabinoid titers and citrate $EC_{50}$, the estimated citrate concentration yielding half-maximal total cannabinoid titers) for 48-hour $yCB_{SCF}$ and $yCB_{SOL}$ cultures incubated for 48 hours in culture media supplemented with 0, 10, 30, 100, 300, 1000, 3000, or 10000 mg/L buffered (pH 6.0) citrate. For all measures, n=3 biological replicates for $yCB_{SCF}$ and $yCB_{SOL}$ cultures. Floating asterisks indicate statistically significant (determined by Bonferroni's multiple comparisons post-hoc test; α=0.05) between-strain differences for $yCB_{SCF}$ versus $yCB_{SOL}$ cultures. Floating data points and bar plots depict means with 95% confidence intervals. Dotted lines represent 95% confidence intervals for regression curve fits. *p<0.05; p<0.01; *p<0.001; ****p<0.0001.

DETAILED DESCRIPTION

This document provides methods and materials for producing cannabinoids in host cells or in vitro using a bidirectional, multi-enzymatic scaffold, which can control the localization and stoichiometry of enzymes catalyzing the biosynthesis of cannabinoids and cannabinoid precursors. As described herein, one or more cannabinoids including cannabigerolic acid (CBGA), cannabidiolic acid (CBDA), cannabichromenic acid (CBCA), and tetrahydrocannabinolic acid, can be produced using a bidirectional, multi-enzymatic scaffold and one or more soluble cannabinoid synthesis enzymes, and the conjugate bases, cannabigerolate, cannabidiolate, cannabichromenate, and tetrahydrocannabinolate, respectively, and decarboxylation products, cannabigerol (CBG), cannabidiol (CBD), cannabichromene (CBC), and tetrahydrocannabinol, respectively, of these cannabinoids also can be produced, as can the tetrahydrocannabinolic acid oxidation product cannabinolic acid and its decararboxylation product cannabinol. The bidirectional, multi-enzymatic scaffold described herein results in significant increases in cannabinoid production in recombinant hosts, including total cannabinoid, CBGA, CBG, CBDA, CBD, CBCA, CBC, and olivetolic acid precursor production, as compared with cannabinoid production in recombinant hosts using the same enzymes that are not bound to a scaffold. As used herein, enzymes that are not bound to a scaffold are referred to as soluble or non-scaffolded. While one particular form of a cannabinoid or other compound may be referenced herein, it is understood that any of its neutral or ionized forms, including any salt forms thereof or decarboxylation derivatives thereof (e.g., produced in the presence of heat and light), are included unless otherwise indicated. It is understood by those skilled in the art that the specific form will depend on factors such as pH and carboxylation status.

Figure 1B:
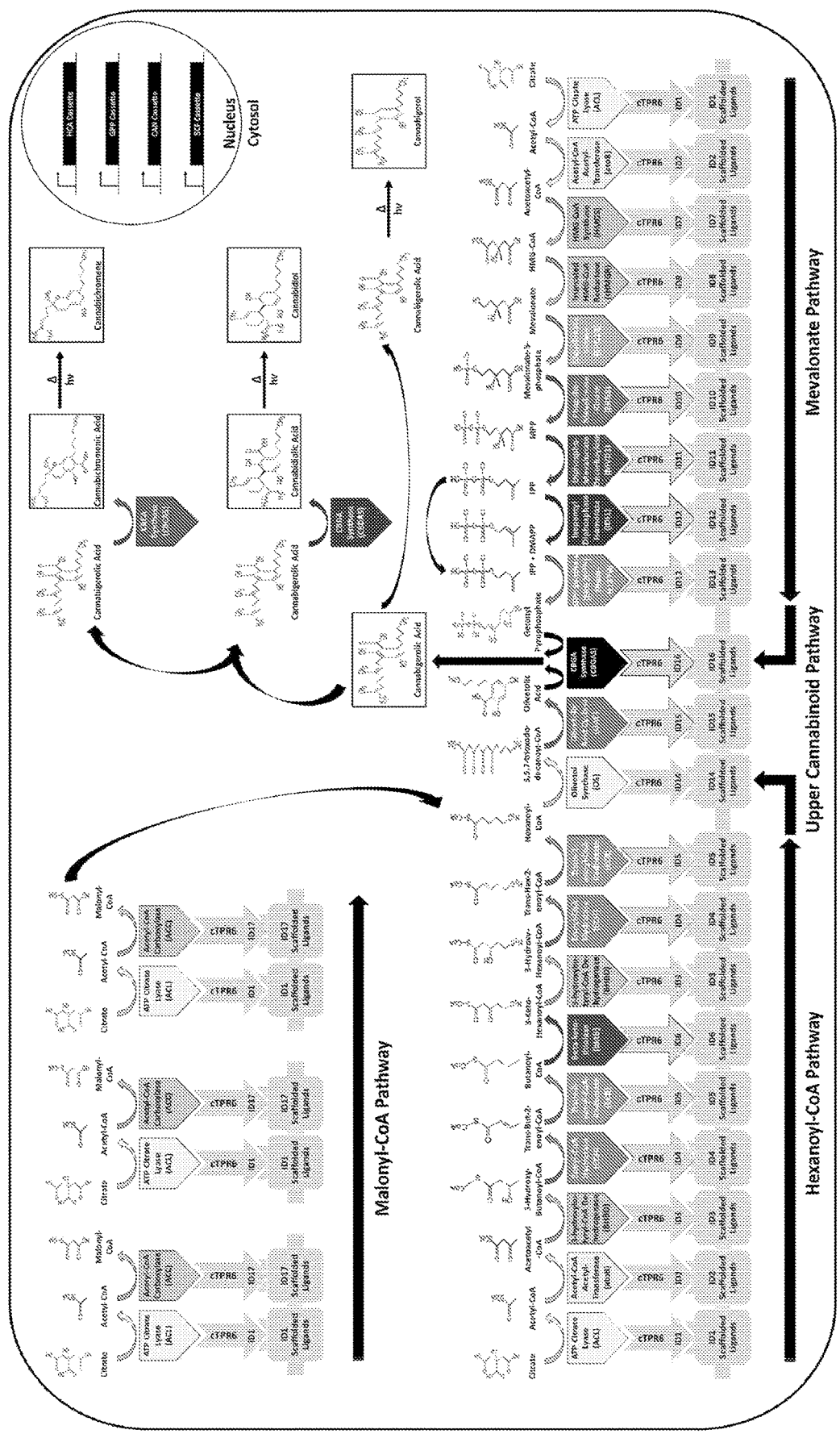
FIG. 1B is a schematic of one representative embodiment of a bidirectional, multi-enzymatic scaffold within a cell (e.g., a yeast cell). The multi-enzymatic scaffold (referred to as SCF gene cassette in the nucleus) includes enzymes of the hexanoyl-CoA pathway (referred to as HCA cassette in nucleus), enzymes of the upper cannabinoid pathway (referred to as CAN cassette in nucleus), and enzymes of the mevalonate pathway (referred to as GPP cassette in nucleus). The schematic also depicts a second scaffold according to one embodiment containing enzymes of the malonyl-CoA pathway and depicts a non-scaffolded CBDAS and a non-scaffolded CBCAS. ID refers to enzyme-linked interaction domain; cTPR6 refers to a spacer sequence; scaffolded ligands refer to the tandem peptide ligands that form the scaffold-binding sites specific for each enzyme-linked ID. The target products CBGA, CBG, CBDA, CBD, CBCA, and CBC are boxed for emphasis. CBG can be produced by decarboxylation of CBGA, CBD can be produced by decarboxylation of CBDA, and CBC can be produced by decarboxylation of CBCA. For each decarboxylation, the 'Δ' symbols represent heat and the 'hv' symbols represent light.

In general, enzymes described herein, which can be co-localized on one or more scaffolds and used for producing cannabinoids or cannabinoid precursors, are engineered to contain an interaction domain (ID), which can be separated from the enzyme by an amino acid spacer sequence at the N- or C-terminus of the enzyme. The ID can be composed of two or more scaffold-binding motifs. The engineered enzymes also can include one or more linkers between the enzyme, spacer, and/or ID. The engineered enzymes can bind to a scaffold, which is a polypeptide that contains unique ID-binding domains, i.e., tandem peptide ligands, as shown in FIG. 1A and FIG. 1B, such that the enzymes are co-localized to the scaffold. In other words, each enzyme can be engineered to contain a protein-protein interaction domain that is specific for ligand or ligands (binding site) on the scaffold such that the enzyme can be localized to a discrete location along the scaffold via non-covalent interactions. In some cases, the engineered enzymes can be chimeric enzymes. The scaffolded ligands can be separated using amino acid linkers or spacers. See, for example, Horn and Sticht, *Frontiers in Bioengineering and Biotechnology*, 2015, volume 3, article 191; Whitaker and Dueber, *Methods in Enzymology*, Chapter 19, "Metabolic Pathway Flux Enhancement by Synthetic Protein Scaffolding," Volume 497, 2011, for descriptions of IDs, binding domains, linkers and spacers. IDs also can be referred to as adaptor domains.

Typically, each interaction domain consists of two tandem scaffold-binding motifs that continue/extend from the C-terminus of the engineered enzyme and that can bind to their corresponding scaffolded peptide ligands, which are constructed in tandem along the scaffold. Dual-binding of enzymes to the scaffold ensures fixed spatial orientation, increases binding specificity for each ID-scaffold interaction, and better tethers each enzyme to the scaffold, all of which can improve pathway flux by enabling substrate channeling through each enzymatic step in the scaffolded biosynthetic pathways.

In some embodiments, there are more than two, e.g., three, four, five, six, seven, eight, nine, or ten, or more molecules of each enzyme localized to the scaffold. In addition, the ratio of any given enzyme in a biosynthetic pathway to any other enzyme in the biosynthetic pathway can be varied. For example, the ratio of one engineered enzyme in a pathway to a second engineered enzyme in the same pathway can be varied, e.g., from about 1:5 to about 5:1, e.g., from about 1:5 to about 2:5, from about 2:5 to about 3:5, from about 3:5 to about 5:5, from about 5:5 to about 5:3, from about 5:3 to about 5:2, or from about 5:2 to about 5:1.

The peptide ligands are typically short peptide sequences, ranging in length from 3 to 50 amino acid residues. For example, a peptide ligand can be 3-10, 7-15, 10-20, 15-25, 20-30, 25-35, 30-40, 35-45, or 40-50 amino acids in length. There is a database of over 200 different motifs available on the web at elm.eu.org that can be used as described herein.

See, for example, Dinkel el al., *Nucleic Acids Res.* 2014; 42(Database issue): D259-D266.

An ID can be a peptide sequence ranging in length 3 to 200 amino acid residues. For example, the ID can be 3-10, 7-15, 10-20, 15-25, 20-30, 25-35, 30-40, 35-45, 40-50, 45-55, 50-60, 65-75, 70-80, 85-95, 90-100, 100-110, 105-115, 110-120, 115-125, 120-130, 125-135, 130-140, 135-145, 140-150, 135-145, 140-150, 145-155, 150-160, 165-175, 170-180, 175-185, 180-190, 185-195, or 190-200 amino acids in length. For example, an ID can be a SH2 domain, a SH3 domain, a PDZ domain, a GTPase binding domain (GBD), a leucine zipper domain, a PTB domain, an FHA domain, a WW domain, a 14-3-3 domain, a death domain, a caspase recruitment domain, a bromodomain, a chromatin organization modifier, a shadow chromo domain, an F-box domain, a HECT domain, a RING finger domain, a sterile alpha motif domain, a glycine-tyrosine-phenylalanine domain, a SNAP domain, a VHS domain, an ANK repeat, an armadillo repeat, a WD40 repeat, an MH2 domain, a calponin homology domain, a Dbl homology domain, a gelsolin homology domain, a PB1 domain, a SOCS box, an RGS domain, a Toll/IL-1 receptor domain, a tetratricopeptide repeat, a TRAF domain, a Bcl-2 homology domain, a coiled-coil domain, a bZIP domain, a fibronectin receptor domain, a FNDC domain, a SAMD domain, a WBP domain, and/or a SASH domain. See, e.g., U.S. Pat. No. 9,856,460 for a list of domains that can be uses as an ID as described herein.

For example, an ID can be a "Src homology2" (SH2) or a "Src homology3" (SH3) domain. SH2 domains are highly conserved structures of approximately 100 amino acid residues that comprise two α-helices and seven β-strands. The SH2 domain can have a promiscuous or strict specificity for a 3-5 amino acid motif flanking a phosphorylated tyrosine. See, Horn and Sticht, 2015, supra. For example, a SH2 domain that can be used as an ID as described herein can be residues 5-122 of a mouse Ct10 regulator of kinase adaptor (Crk) protein having GenBank Accession No. AAH31149.

SH3 domains are small modules of approximately 60 residues that bind proline-rich ligands, which bind to the domain surface at three shallow grooves formed by conserved aromatic residues and exhibit two different binding orientations. See, Horn and Sticht, 2015, supra. In some embodiments, the proline-rich ligand can have a core PXXP motif flanked by a positively charged residue. Class I PZP domains recognize ligands conforming to the consensus+ XXPXXP (where + is either Arg or Lys), while Class II domains recognize PXXPX+motifs and bind to ligands in the opposite orientation. See, Teyra, et al., *FEBS Lett.,* 2012 586(17):2631-7. Individual SH3 domains do not measurably interact with other SH3 domain family ligands within an organism, minimizing cross-talk and increasing the number of domain/ligand pairs available for simultaneous use. See, Whitaker and Dueber, 2011, supra. For example, a SH3 domain that can be used as an ID as described herein can be residues 134-190 of a mouse Crk protein having GenBank Accession No. AAH31149 and its peptide ligand can be PPPALPPKRRR (SEQ ID NO: 1).

For example, an ID can be a PDZ (PSD-95/Discs-large/ ZO1) domain. PDZ domains are approximately 100 amino acid residues in length and target specific motifs at the C-terminus of the binding partner. The peptide ligand adopts a 3-strand and extends an existing 3-sheet within the PDZ domain upon binding. At least four different classes of ligands are known for PDZ domains exhibiting a distinct binding specificity. See, Horn and Sticht, 2015, supra. For example, grouped PDZ domains into two main specificity classes based on distinct ligand signatures: Class I PDZ domains recognize a (X[T/S]XφCOOH) motif, Class II PDZ domains recognize a (XφXφCOOH) motif, and Class III PDZ domains recognize a X[ED]XφCOOH motif, where X is any residue and 4 is a hydrophobic amino acid. See, Teyra, et al., 2012, supra. PDZ and SH3 domains are found throughout eukaryotic and eubacterial genomes. For example, a PDZ domain that can be used as an ID as described herein can be residues 77-171 of a mouse α-syntrophin protein having GenBank Accession No. EDL06069 and the peptide ligand can be GVKESLV (SEQ ID NO:208).

For example, an ID can be a GBD domain from a protein such as the Wiskott-Aldrich syndrome-like protein (N-WASP). Isolated GBD domains do not adopt a single, discrete structure under physiological conditions but rather exhibit multiple, loosely packed conformations in solution. The corresponding peptide ligand has been deduced from the autoinhibited form of the GBD. See, Horn and Sticht, 2015, supra. For example, a GBD domain that can be used as an ID described herein can include residues 196 to 274 of a rat N-WASP protein having GenBank Accession No. BAA21534, and its peptide ligand, which can be LVGALMHVMQKRSRAIHSSDEGEDQAGDEDED (SEQ ID NO:2), can be used as a peptide ligand as described herein.

For example, an ID can have a leucine zipper or synthetic coiled-coil domain. A leucine zipper domain can include multiple interspersed leucine residues approximately seven amino acid residues apart. Havranek, and Harbury ((2003), *Nat. Struct. Biol.* 10, 45-52) identified new pairs of homodimers or heterodimers by altering residues between leucine zipper pairs based on computational prediction. Reinke, et al. ((2010). *J. Am. Chem. Soc.* 132, 6025-6031) identified three pairs of synthetic coiled coils that do not exhibit measurable self-association. See, Whitaker and Dueber, 2011, supra. One example of an ID that can be used as described herein can be ITIRAAFLEKENTALRTEIAEL-EKEVGRCENIVSKYETRYGPL (SEQ ID NO:3), and its peptide ligand for use as described herein can be LEIRAAF-LEKENTALRTRAAELRKRVGRCRNIVSKYETRYGPL (SEQ ID NO:4).

For example, an ID can be a dockerin polypeptide, which can localize to a specific cohesion polypeptide on a scaffold described herein. Cohesion-dockerin pairs are particularly useful for ex vivo applications as binding is calcium dependent. See, Whitaker and Dueber, 2011, supra.

Combinations of IDs that have high affinity for their peptide ligands and high specificity, i.e., minimal cross-reactivity, can be used as described herein to allow for binding of multiple, different enzymes to a scaffold provided herein. For example, at least three different enzymes can be localized on a scaffold. In some embodiments, at least four different enzymes can be localized on a scaffold. In some embodiments, at least five different enzymes can be localized on a scaffold. In some embodiments, at least six different enzymes can be localized on a scaffold. In some embodiments, at least seven different enzymes can be localized on a scaffold. In some embodiments, at least eight different enzymes can be localized on a scaffold. In some embodiments, at least nine different enzymes can be localized on a scaffold. In some embodiments, at least ten different enzymes can be localized on a scaffold. In some embodiments, at least eleven different enzymes can be localized on a scaffold. In some embodiments, at least twelve different enzymes can be localized on a scaffold. In some embodiments, at least fifteen different enzymes can be localized on a scaffold. In some embodiments, at least seventeen different enzymes can be localized on a scaffold. In some embodiments, at least eighteen different enzymes can be localized on a scaffold. In some embodiments, at least twenty different enzymes can be localized on a scaffold. In some embodiments, at least twenty-one different enzymes can be localized on a scaffold.

Table 1 provide exemplary combinations of heterologous IDs, i.e., IDs that are so different from each other, that can be used in seventeen different engineered enzymes and Table 2 provides the corresponding exemplary combinations of peptide ligands that can be used to localize the seventeen different enzymes to one or more scaffolds. In the embodiments shown in Tables 1 and 2, each ID is composed of two tandem peptide motifs as are the corresponding peptide ligands, which interact with the tandem peptide motifs. It will be appreciated that any one of the enzymes listed in Tables 1 and 2 can be used in combination with any of the listed combinations of IDs and corresponding peptide ligands.

TABLE 1

Interaction Domain Motif Sequences in Engineered Enzymes

| Enzyme | ID # | ID Motif #1 | ID Motif #1 Amino Acid Sequence | ID Motif #2 | ID Motif #2 Amino Acid Sequence |
|---|---|---|---|---|---|
| ATP Citrate Lyase | 1 | SYNZIP1 | SYYHHHHHHLESTSLYKKAGSG SNLVAQLENEVASLENENETLK KKNLHKKDLIAYLEKEIANLRK KIEE ((SEQ ID NO: 5)) | SYNZIP2 | SYYHHHHHHLESTSLYKKAGSGS ARNAYLRKKIARLKKDNLQLERD EQNLEKIIANLRDEIARLENEVASH EQ (SEQ ID NO: 6) |
| Acetyl-CoA Acetyltransferase (atoB) | 2 | SYNZIP3 | SYYHHHHHHLESTSLYKKAGSG SNEVTTLENDAAFIENENAYLE KEIARLRKEKAALRNRLAHKK (SEQ ID NO: 7) | SYNZIP4 | SYYHHHHHHLESTSLYKKAGSGS QKVAELKNRVAVKLNRNEQIKNK VEELKNRNAYLKNELATLENEVA RLENDVAE (SEQ ID NO: 8) |
| 3-hydroxybutyryl-CoA Dehydrogenase | 3 | MYND | ENLYFQGENLYFQGDSSESCWN CGRKASETCSGCNTARYCGSFC QHKDWEKHHHICGQTLQAQQ (SEQ ID NO: 9) | UEV | MAVSESQLKKMVSKYKYRDLTVR ETVNVITLYKDLKPVLDSYVFNDG SSRELMNLTGTIPVPYRGNTYNIPI CLWLLDTYPYNPPICFVKPTSSMTI KTGKHVDANGKIYLPYLHEWKHP QSDLLGLIQVMIVVFGDEPPVFSRP (SEQ ID NO: 10) |
| Enoyl-CoA Hydratase | 4 | PABP | GPLGSPLTASMLASAPPQEQKQ MLGERLFPLIQAMIIPTLAGKITG MLLEIDNSELLHIVILESPESLRSK VDEAVAVLQAHQAKEAAQKA (SEQ ID NO: 11) | MDM2 | NTNMSVPTDGAVTTSQIPASEQET LVRPKPLLLKLLKSVGAQKDTYT MKEVLFYLGQYIMTKRLYDEKQQ HIVYCSNDLLGDLFGVPSFSVKEH RKIYTMIYRNLVV (SEQ ID NO: 12) |
| Trans-Enoyl-CoA Rednetase | 5 | SYNZIP10 | SYYHHHHHHLESTSLYKKAGSG SNLLATLRSTAAVLENENHVLE KEKEILRKEKEQLLNKLEAYK (SEQ ID NO: 13) | SYNZIP22 | SYYHHHHHHLESTSLYKKAGSGS KRIAYLRKKIAAIKKDNANLEKDI ANLENEIERLIKEIKTLENEVASHE Q (SEQ ID NO: 14) |
| Beta-ketothiolase (bktB) | 6 | GYF | DVMWEYKWENTGDAELYGPFT SAQMQTWVSEGYLPDGVYCRK LDPPGGQFYNSKRIDFDLYT (SEQ ID NO: 15) | PAH | ESDSVEFNNMSYVNKIKTRFLDHP EIYRSFLEILIITYQKEQLHTKGRPF RGMSEEEVFTEVANLFRGQEDLLS EFGQFLPEAKR (SEQ ID NO: 16) |
| HMG-CoA Synthase | 7 | WW1A | LGPLPPGWEVRSTVSGRIYFVD HNNRTTQFTDPRLH (SEQ ID NO: 17) | WW1B | GAMGPLPPGWEKRTDSNGRVYFV NHNTRITQWEDPRS (SEQ. ID NO: 18) |
| HMG-CoA Reductase | 8 | FOS | SYYHHHHHHLESTSLYKKAGSE FFRRERNKMAAAKCRNRRRELT DTLQAETDQLEDEKSALQTEIA NLLKEKEKLEFILAAHRPACKIP DDLGFPEEMSLE (SEQ ID NO: 19) | SYNZIP9 | SYYHHHHHHLESTSLYKKAGSGS QKVESLKQKIEELKQRKAQLKNDI ANLEKEIAYAET (SEQ ID NO: 20) |
| Mevaionate Kinase | 9 | VHS1 | MEPAMEPETLEARINRATNPLN KELDWASINGFCEQLNEDFEGP PLATRLLAHKIQSPQEWEMQAL TVLETCMKSCGKRIEIDEVGKFR FLNELIKVVSPKYLGSRTSEKVK NKILELLYSWTVGLPEEVKIAEA YQMLKKQGIVKS (SEQ ID NO: 21) | VHS2 | GAMGSMAEAEGESLESWLNKATN PSNRQEDWEYIIGFCDQINKELEGP QIAVRLLAHKIQSPQEWEALQALT VLEACMKNCGRRFHNEVGKFRFL NELIKVVSPKYLGDRVSEKVKTKV IELLYSWTMALPEEAKIKDAYHML KRQGIVQSDPPIPVDRTLIPSPPPRP KN (SEQ ID NO: 22) |
| Phosphomevalonate Kinase | 10 | SYNZIP13 | SYYHHHHHHLESTSLYKKAGSG SQKVEELKNKIAELENRNAVKK NRVAHLKQEIAYLKDELAAHEF E (SEQ ID NO: 23) | SYNZIP15 | SYYHHHHHHLESTSLYKKAGSGSF ENVTHEFILATLENENAKIRRLEA KLERELARLRNEVAWLL (SEQ ID NO: 24) |

TABLE 1-continued

Interaction Domain Motif Sequences in Engineered Enzymes

| Enzyme | ID # | ID Motif #1 | ID Motif #1 Amino Acid Sequence | ID Motif #2 | ID Motif #2 Amino Acid Sequence |
|---|---|---|---|---|---|
| Diphosphomevalonate Decarboxylase | 11 | MATH | AMADLEQKVLEMEASTYDGVFI WKISDFPRKRQEAVAGRIPAIFS PAFYTSRYGYKNICLRTYLNGDG TGRGTHLSLFFVVMKGPNDALL RWPPFNQKVFLNILLDQNNREHV IDAFRPDVTSSSTQRPVNDMNIA SGCPLFCPVSKNMEAKNSYVRDD AIFIKAWDLTGL (SEQ ID NO: 25) | SKP1 | ASIKLQSSDGEIFEVDVEIAKQSVTI KTMLEDLGMDDEGDDDPVPLPNV NAAILKVIQWCTHHKDDPPPPED DENKEKRTDDIPVWDQEFLKVDQ GTLFELILAANYLDIKGLLDVTCKT VANNIIKGKTPEEIRKTFNIKNDFTE EEEAQVRKENQWC (SEQ ID NO: 26) |
| Isopentenyl-Diphosphate Delta-Isomerase | 12 | SYNZIP5 | SYYHHHHHHLESTSLYKKAGSG SNTVKELKNYIQELEERNkELK NLKEHLKFAKAELEFELAAHKF E (SEQ ID NO: 27) | SYNZIP6 | SYYHHHHHHLESTSLYKKAGSGS QKVAQLKNRVAYKLKENAKLENI VARLENDNANLEKDIANLEKDIAN LERDVAR (SEQ ID NO: 28) |
| Geranyl-Diphosphate Synthase | 13 | PDZA | LCTIVIKKGPSGYGFNLBSDKSKP GQFIRSVDPDSPAEASGLRAQDR IVEVNENCNIEGKQHGDVVSAIR AGGDETKLLVVDRE (SEQ ID NO: 29) | PDZ2 | SSGAIIYTVELKRYGGPLGITISGTE EPFDPIIISSLTKGGLAERTGAIHIG DRILMNSSSLKGKPLSEAIHLLQM AGETVFLKIKKQTDAQPASS (SEQ ID NO: 30) |
| Olivetol Synthase | 14 | SH2A | GNNLETYEWYNKSISRDKAEKL LLIDTGKEGAFMVRDSRTPGTYT VSNTTKAIISENPOKHYHIKETN DSPKRYYVAEKYVFDSIPLLIQY HQYNGGGLVTRLRYPVCG (SEQ ID NO: 31) | SH2B | GSHPWTTGKIPRAKAEEMLSKQRH DGAFLIRESESAPGDFSLSVKFGND VQHFKVLRDGAGKYFLVVVNTKFNS LNELVDYHRSTSVSRNQQIFIRDIE QVPQQPT (SEQ ID NO: 32) |
| Olivetotic Acid Cyclase | 15 | PTB1 | GQDRSEATLIKRFKGEGVRYKA KLIGIDEVSAARGDKLCQDSMM KLKGVVAGARSKGEHKQKIFLT ISFGGIKIFDEKTGALQHHHAVH EISYIAKDTFDHRAFGYVCGKEG NHRFVAIKTAQAAEPVILDLRDL FQLIYELKQREELEKKA (SEQ ID NO: 33) | PTB2 | GSHMGSQFWVTSQKTEASERCGL QGSYILRVEAEKLTLLTLGAQSQIL EPLLFWPYTURRIGRDKVMFSTE AGRRCPSGPGIFTFQTSQGNDIFQ AVEAAIQQQKAQGKVGQAQDILR LEHHHHHH (SEQ ID NO: 210) |
| CBGA Synthase | 16 | SH34 | AINVRALFDFNGNDEEDLPFKK GDILRIRDKPEEQWWNAEDSEG KRGMIPVPYVEKY (SEQ ID NO: 34) | SH3B | LIKHMRAEALFDFTGNSKLELNFK AGDVIFLLSRINKDWLEGTVRGAT GFPPLSFVKILK (SEQ ID NO: 35) |
| Acetyl-CoA Carboxylase | 17 | FAT | GSFIMRLGAQSIQPTANLDRTDD LVYLNVMELVRAVLELKNELA QLPPEGYVVVVKNVGLTRKLI GSVDDLLPSLPSSSRTEIEGTQKL LNKDLAELINKNIRLAQQNAVTS LSEECKRQMLTASHTLAVDAKN LLDAVDQAKVLANLAHPPAE (SEQ ID NO: 36) | PEX | GAMATPGSENVLPREPLIATAVKF LQNSRVRQSPLATRRAFLKKKGLT DEELDMAFQQSGTAADEPSSLW (SEQ ID NO: 37) |

TABLE 2

Tandem Peptide Ligand Sequences in Scaffold

| Enzyme | ID # | ID Motif #1 | ID Motif #1 Scaffolded Ligand Amino Acid Sequence | ID Motif #2 | ID Motif #2 Scaffolded Ligand Amino Acid Sequence |
|---|---|---|---|---|---|
| ATP Citrate Lyase | 1 | SYNZIP1 | SYYHHHHHHLESTSLYKKAGS GSARNAYLRKKIARLKKDNLQ LERDEQNLEKIIANLRDEIARLE NEVASHEQ (SEQ ID NO: 6) | SYNZIP2 | SYYHHHHHHLESTSLYKKAGSGS NLVAQLENEVASLENENETLKKK NLHKKDLIAYLEKEIANLRKKIEE (SEQ ID NO: 5) |
| Acetyl-CoA Acetyltransferase (atoB) | 2 | SYNZIP3 | SYYHHHHHHLESTSLYKKAGS GSQKVAELKNRVAVKLNRNEQ LKNKVEELKNRNAYLKNELAT LENEVARLENDVAE (SEQ ID NO: 8) | SYNZIP4 | SYYHHHHHHLESTSLYKKAGSGS NEVTTLENDAAFIENENAYLEKEI ARLREKEKAALRNRLAHKK (SEQ ID NO: 7) |
| 3-hydroxybutyryl-CoA Dehydrogenase | 3 | MYND | RPPTISNPPPLISSAKHPSV (SEQ ID NO: 38) | UEV | NFLQSRPEPTAPPEESFRSG (SEQ ID NO: 39) |

TABLE 2-continued

Tandem Peptide Ligand Sequences in Scaffold

| Enzyme | ID # | ID Motif #1 | ID Motif #1 Scaffolded Ligand Amino Acid Sequence | ID Motif #2 | ID Motif #2 Scaffolded Ligand Amino Acid Sequence |
|---|---|---|---|---|---|
| Enoyl-CoA Hydratase | 4 | PABP | SKGTGLNPNAKVWQEIAPGN (SEQ ID NO: 40) | MDM2 | PDGGTTFEHLWSSLEPDSTY (SEQ ID NO: 41) |
| Trans-Enoyl-CoA Reductase | 5 | SYNZIP10 | SYYHHHHHHLESTSLYKKAGS GSKRIAYIRKKIAALKKDNAN LEKDIANLENEIERLIKEIKTLE NEVASHEQ (SEQ ID NO: 14) | SYNZIP22 | SYYHHHHHHIESTSLYKKAGSGS NLLATIRSTAAVLENENHVLEKEK EKLRKEKEQLLNKLEAYK (SEQ ID NO: 13) |
| Beta-Ketothiolase (bktB) | 6 | GYF | PATSQHPPPPPGHRSQAPSH (SEQ ID NO: 42) | PAH | ELNSLLILLEAAEYLERRDR (SEQ ID NO: 43) |
| HMG-CoA Synthase | 7 | WW1A | FQMPADTPPPAYLPPEDPMT (SEQ ID NO: 44) | WW1B | ERESNEEPPPPYEDPYWGNG (SEQ ID NO: 45) |
| HMG-CoA Reductase | 8 | FOS | SYYHHHHHHLESTSLYKKAGS GSQKVESLKQKIEELKQRKAQL KNDIANLEKEIAYAET (SEQ ID NO: 20) | SYNZIP9 | SYYHHHHHHLESTSLYKKAGSEFF RRERNKMAAAKCRNRRRELTDTL QAETDQUEDEKSALQTEIANLLKE KEKLEFILAAHRPACKIPDDLGFPE EMSLE (SEQ ID NO: 19) |
| Mevalonate Kinase | 9 | VHS1 | VSSTKLVSFHDDSDEDLLHI (SEQ ID NO: 46) | VHS2 | AAATPISTFHDDSDEDLLHV (SEQ ID NO: 47) |
| Phosphomevalonate Kinase | 10 | SYNZIP13 | SYYHHHHHHLESTSLYKKAGS GSFENVTHEFLLATLENENAKL RRLEAKLERELARLRNEVAWL (SEQ ID NO: 24) | SYNZIP15 | SYYHHHHHHLESTSLYKKAGSGS QKVEELKNKIAELENRNAVKKNR VAHLKQEIAYLKDELAAHEFE (SEQ ID NO: 23) |
| Diphosphomevalonate Decarboxylase | 11 | MATH | HDDSLPHPQQATDDSGHESD (SEQ ID NO: 48) | SKP1 | GSPNAGSVEQTPKKPGLRRR (SEQ ID NO: 49) |
| Isopentenyl-Diphosphate Delta-Isomerase | 12 | SYNZIP5 | SYYHHHHHHLESTSLYKKAGS GSQKVAQLKNRVAYKLKENA KLENIVARLENDNANLEKDIAN LEKDIANLERDVAR (SEQ ID NO: 28) | SYNZIP6 | SYYHHHHHHLESTSLYKKAGSGS NTVKELKNYIQELEERNAELKNLK EHLKFAKAELEFELAAHKFE (SEQ ID NO: 27) |
| Geranyl-Diphosphate Synthase | 13 | PDZ1 | TDEEREETEEEVYLLNSTTL (SEQ ID NO: 50) | PDZ2 | DGNVSGTQRLDSATVRTYSC (SEQ ID NO: 51) |
| Olivetol Synthase | 14 | SH2A | ALVDDAADYEPPPSNNEEAL (SEQ ID NO: 52) | SH2B | RELFDDPSYVNVQNLDKARQ (SEQ ID NO: 53) |
| Olivetolic Acid Cyclase | 15 | PTB1 | KNTKSMNFDNPVYRKTTEEE (SEQ ID NO: 54) | PTB2 | RSLPSTWIENKLYGMSDPNW (SEQ ID NO: 55) |
| CBGA Synthase | 16 | SH3A | VVDNSPPPALPPKKRQSAPS (SEQ ID NO: 56) | SH3B | TQRSKPQPAVPPRPSADLIL (SEQ ID NO: 57) |
| Acetyl-CoA Carboxylase | 17 | FAT | SATRELDELMASLSDFKIQG (SEQ ID NO: 58) | PEX | DLALSENWAQEFLAAGDAVD (SEQ ID NO: 59) |

The spacers or linkers connecting an enzyme and ID, as well as a binding domain on a scaffold, can be peptide sequences ranging in length from 6 to 250 amino acid residues. The term "spacer" typically refers to a longer and more structurally-rigid peptide sequence and the term "linker" typically refers to a shorter and more structurally-flexible peptide sequence. In embodiments in which both terms are used, linker typically refers to a sequence that is about 3 to about 50 amino acids in length and spacer typically refers to a sequence that is longer (e.g., about 36 to about 250 amino acids in length). For example, a linker can be 6-15, 10-20, 15-25, 20-30, 25-35, 30-40, 35-45, or 40-50 amino acids in length. A spacer can be, for example, 36-40, 40-50, 45-55, 50-60, 55-65, 60-70, 65-75, 70-80, 75-85, 90-100, 95-105, 100-110, 105-115, 110-120, 115-125, 120-130, 125-135, 130-140, 135-145, 140-150, 145-155, 150-160, 165-175, 170-180, 175-185, 180-190, 185-195, 190-200, 195-205, 200-210, 205-215, 210-220, 215-225, 220-230, 225-235, 230-240, 235-245, or 240-250 amino acids in length. See, for example, Chen, el al., *Adv Drug Deliv Rev.* 2013 65(10): 1357-1369. In either case, the linker/spacer can be a series of small and/or hydrophilic and/or other amino acid residues that can adapt flexible and/or rigid structures. For example, the linker can be a series of glycine residues, a series of alanine residues, a series of serine residues, or a series of alternating glycine and serine (or threonine) residues such as $(G-S)_8$ (SEQ ID NO:60), $(G-S)_{10}$ (SEQ ID NO:61), or $(G-S)_{15}$ (SEQ ID NO:62), or contain mainly glycine residues such as $(GGGGS)_3$ (SEQ ID NO:63) or $(GGGGS)_4$ (SEQ ID NO:64), or contain any other series of canonical or non-canonical amino acid residues or combinations thereof. In some embodiments, a linker can include glutamic acid, alanine, and lysine residues such as $(EAAAK)_2$ (SEQ ID NO:65), $(EAAAK)_3$ (SEQ ID NO:66), or $(EAAAK)_4$ (SEQ ID NO:67). See, Horn and Sticht, 2015, supra. In some embodiments, a linker can be a combination of glycine, alanine, proline and methionine residues, such as AAAGGM (SEQ ID NO:68), AAAGGMPPAAAGGM (SEQ ID NO:69), AAAGGM (SEQ ID NO:70), or PPAAAGGMM (SEQ ID NO:71). See, e.g., U.S. Pat. No. 9,856,460.

Based on amino acid composition, linkers or spacers can be either structured or intrinsically unstructured. For example, in some embodiments, a spacer can have a sequence that adopts a more structurally-rigid α-helical conformation and a linker can have a GS-rich peptide sequence that is more structurally-flexible. For example, in some embodiments, a linker can include flexible GS-rich sequences flanking one or more rigid α-helical moieties, e.g., GS-rich sequences flanking duplicate, triplicate, or quadruplicate α-helical moieties. For example, in some embodiments, a linker or spacer can have the sequence GSAGSAAGSGEF (SEQ ID NO:72), KLSGGGGSGGGGSGGGGS (SEQ ID NO:73), GSAGSAAGSGEFGSAEAAAKEAAAK-AGSAGSAAGSGEFGS (SEQ ID NO:74), GSAGSAAGSGEFAEAAAKEAAAK-AGSAGSAAGSGEF (SEQ ID NO:75), or GSAGSAAGSGEFG-SAEAAAKEAAAKEAAAKEAAAK-AGSAGSAAGSGEFGS (SEQ ID NO:76).

In some embodiments, the ligands on the scaffold can be separated by linkers that are 20-50 amino acid residues in length (e.g., 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 amino acid residues in length). In some embodiments, the IDs engineered at the C-terminus or N-terminus of each scaffolded enzyme can contain a linker (e.g., a flexible linker) of 15 to 30 (e.g., 20) amino acid residues in length flanking a spacer of 15 to 50 (e.g. 36) amino acid residues. In some embodiments, the ID can be separated from the enzyme by a spacer sequence such as the cTPR6 spacer, which includes sextuplicate rigid α-helical moieties and can have the sequence:

(SEQ ID NO: 77)
AEAWYNLGNAYYKQGDYQKAIEYYQKALELDPNNAEAWYNLGNAYYKQGDY

QKAIEYYQKALELDPNNAEAWYNLGNAYYKQGDYQKAIEDYQKALELDPNN

LQAEAWKNLGNAYYKQGDYQKAIEYYQKALELDPNNASAWYNLGNAYYKQG

DYQKAIEYYQKALELDPNNAKAWYRRGNAYYKQGDYQKAIEDYQKALELDP

NNRSRSA.

Figure 3:
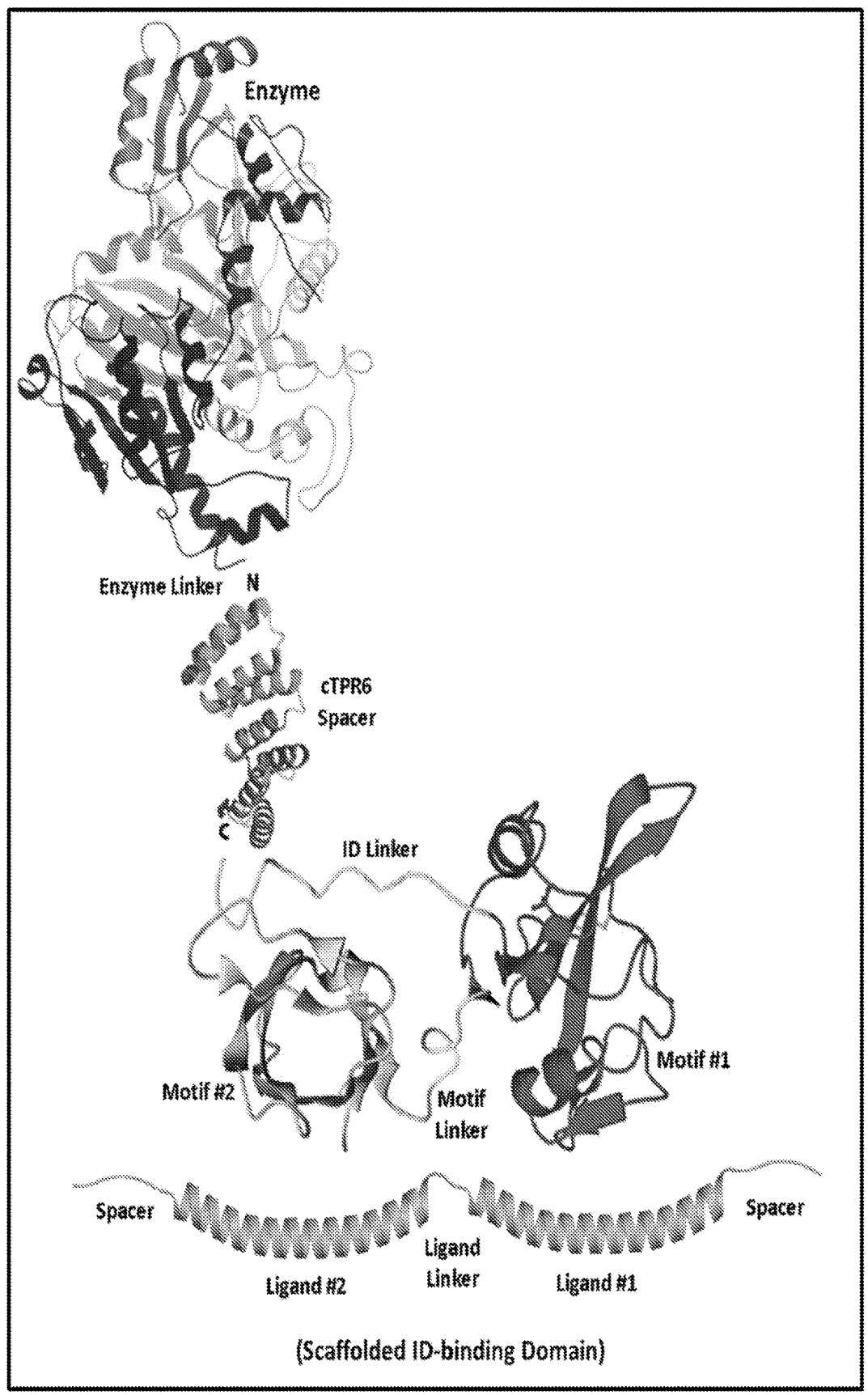
FIG. 3 is an example of an enzyme-scaffold complex.

In some embodiments, the engineered enzyme can be of a formula: enzyme-linker$_1$-spacer-linker$_2$-motif$_1$-linker-motif$_2$, where linkers 1, 2, and 3 can be the same or different, and motif 1 and motif$_2$ can be the same or different. In some embodiments, linker 1 can be referred to as the enzyme linker, i.e., it connects the enzyme to the spacer such as cTPR6 spacer, and can include flexible GS-rich moieties flanking a rigid α-helical moiety such as KLSGGGGSGGGGSGGGGS (SEQ ID NO:73). In some embodiments, linker 2 can be referred to as the ID linker and can include, for example, flexible GS-rich moieties flanking a rigid α-helical moiety such as GGGGSGGGGSGGGGAS (SEQ ID NO:78). In some embodiments, linker 3 can be referred to as the motif linker and can include flexible GS-rich moieties flanking a rigid α-helical moiety such as GSAGSAAGSGEFGSAEAAAKEAAAK-AGSAGSAAGSGEFGS (SEQ ID NO:74). Table 1 provides non-limiting examples of motifs 1 and motifs 2, which are used together to form heterologous IDs. FIG. 3 contains a schematic of an exemplary engineered enzyme of this formula complexed with a scaffold. FIG. 6B and FIGS. 13A-C contain the amino acid sequence of an ATP citrate lyase, atoB, a 3-hydroxybutyryl-CoA dehydrogenase, an enoyl-CoA hydratase, a trans-enoyl-CoA reductase, a beto-keto-thiolase (bktB), an HMG-CoA synthase, a truncated HMG-CoA reductase, a mevalonate kinase, a phosphomevalonate kinase, a diphosphomevalonate decarboxylase, an isopentenyl-diphosphate delta isomerase, a geranyl-diphosphate synthase (ERG20$^{WW}$), an olivetol synthase, an olivetolic acid cyclase, a CBGA synthase, and an acetyl-CoA carboxylase according to this formula. In some embodiments, linkers 1 and 2 can be $(G_4S)_3$, the spacer can be the cTPR6 sequence, and linker 3 can be $(GS)_8$.

In some embodiments, a scaffold can be of a formula: N-terminus-[Ligand #1-linker-Ligand #2-Spacer]n-(optionally-tagged)C-terminus, where n is the number of interaction domains. The linker can be referred to as a scaffolded ligand linker and can be used to connect and separate paired motif-binding ligands that recruit/localize each enzyme to its scaffold-binding site. Such a linker can include flexible GS-rich moieties flanking a rigid α-helical moiety and have a sequence such as GSAGSAAGSGEFAEAAAKEAAAK-AGSAGSAAGSGEF (SEQ ID NO:75). The spacer can be referred to as a scaffolded ID-binding site spacer and can be used to connect and separate the scaffold-binding sites (composed of the paired motif binding ligands) for each enzyme. Such a spacer can include flexible GS-rich moieties flanking a rigid α-helical moiety and have a sequence such as GSAGSAAGSGEFG-SAEAAAKEAAAKEAAAKEAAAK-AGSAGSAAGSGEFGS (SEQ ID NO:76). The N-terminus can include a flexible GS-rich sequence to help stabilize and solubilize the scaffold. For example, the N-terminus can have the sequence GSAGSAAGSGEFGSAGSAAGSGEFGSAGSAAGSGEF (SEQ ID NO:79). The C-terminus can include a flexible GS rich sequence flanking a rigid α-helical moiety to stabilize and solubilize the scaffold and can be optionally tagged (e.g., with a MYC tag, a FLAG tag, or other tag described below) to ease purification or detection of the scaffold. For example, a C-terminal sequence with a triplicate MYC tag can have the sequence GSAGSAAGSGEFG-SAEAAAKEAAAKEAAAKEAAAK-AGSAGSAAGSGEFGSEQK LISEEDLEQKLISEED-LEQKLISEEDLGSAGSAAGSGEFGSAGSAAGSGEF-GSAGS AAGSGEF (SEQ ID NO:80). For example, a C-terminal sequence with a triplicate FLAG tag can have the sequence GSAGSAAGSGEFG-SAEAAAKEAAAKEAAAKEAAAK-AGSAGSAAGSGEFGSDYK DDDDKDYKDDDDKDYKDDDDKGSAGSAAGS-GEFGSAGSAAGSGEFGSAGSAA GSGEF (SEQ ID NO:81). FIG. 6C and FIG. 13D each contain an example of a scaffold polypeptide of this formula that contains the peptide ligands corresponding to IDS 1-16 as shown in Table 2, and a triplicate MYC tag on the C-terminus. For example, FIG. 13D contains an example of a scaffold polypeptide (see SCF gene cassette of FIG. 2B) containing a triplicate MYC tag. FIG. 6D and FIG. 13D each contain an example of a scaffold polypeptide that contains the peptide ligands corresponding to IDs 1 and 17 as shown in Table 2 and a triplicate FLAG tag on the C-terminus. Accordingly, the amino acid sequence of a scaffold can depend on the sequence of the peptide ligands that can bind to the selected ID motif of the enzymes.

In some embodiments, any one of the enzymes can be engineered to include an N-terminal or C-terminal linker motif that allows covalent (isopeptide) bonding to the scaffold. See, for example, the SpyTag and SpyCatcher system described by Zakeri, et al., *Proc. Natl. Acad. Sci.*, 2012 109 (12) E690-E697.

In some embodiments involving multi-enzymatic scaffolds described herein, the first engineered enzyme of a biosynthetic pathway can produce a first product that can be a substrate for the second engineered enzyme of the biosynthetic pathway, the second engineered enzyme of the biosynthetic pathway can produce a second product that can be a substrate for the third engineered enzyme of the biosynthetic pathway, and so forth. In some cases, the second engineered enzyme can be immobilized on the scaffold such that it is positioned adjacent to or very close to the first engineered enzyme. The third engineered enzyme can be immobilized on the scaffold such that it is positioned adjacent or very close the second engineered enzyme. In this way, the effective concentration of the first product can be high, and the second engineered enzyme can act efficiently on the first product, the third engineered enzyme can act efficiently on the second product, and so forth.

As shown in FIGS. 1A and 1B, one example of a multi-enzymatic scaffold contains enzymes of the hexanoyl-CoA pathway on the N-terminus of the scaffold, enzymes of the mevalonate pathway on the C-terminus of the scaffold, and enzymes of the upper cannabinoid pathway in between. Within any of the pathways, the enzymes can be from a single source, i.e., from one species or genera, or can be from multiple sources, i.e., different species or genera. Nucleic acids encoding the enzymes described herein have been identified from various organisms and are readily available in publicly available databases such as GenBank or EMBL (see below).

A fully-assembled multi-enzymatic scaffold provided herein can adopt stoichiometry and a spatial arrangement that can help maximize pathway flux and minimize accumulation of pathway intermediates and by-products. Such scaffolds can facilitate substrate channeling both within and between cannabinoid and cannabinoid precursor pathways. Specifically, this scaffolding system can facilitate unidirectional flux through each of the primary cannabinoid precursor pathways, and converging near the midpoint of the scaffold. The hexanoyl-CoA/olivetolic acid (OVA) pathway can begin at the N-terminus of the scaffold, and the mevalonate or MEP pathway can begin at the C-terminus of the scaffold. The enzyme catalyzing the rate-limiting/committed step in cannabinoid biosynthesis, a CBGA synthase, can be localized at the intersection of these precursor pathways near the scaffold midpoint.

By this design, the two primary precursors for cannabinoid biosynthesis, hexanoyl-CoA/olivetolic acid and geranyl pyrophosphate, can be bi-directionally delivered to a CBGA synthase at this intersection. The CBGA synthase can catalyze biosynthesis of CBGA, the primary cannabinoid from which all other cannabinoids are derived. Substrate channeling within and between the scaffolded pathways can accelerate the kinetics of the composite pathway in accordance with the law of mass action.

In the embodiment shown in FIGS. 1A and 1B, the N-terminal hexanoyl-CoA pathway can include an ATP citrate lyase (ACL) (also can be referred to as an ATP citrate synthase), an acetyl-CoA acetyltransferase (atoB), two 3-hydroxy-acyl-CoA dehydrogenases (BHBDs), two enoyl-CoA hydratases (ECHs), a beta-ketothiolase (bktB), and two trans-2-enoyl-CoA-reductases (ECRs).

In the hexanoyl-CoA pathway shown in FIGS. 1A and 1B, citrate, from cellular metabolism and/or supplemented in the growth medium, can be used as a substrate for ACL-catalyzed acetyl-CoA synthesis. ACL is classified under EC 2.3.3.8. Acetyl-CoA can be used as a substrate for atoB-catalyzed acetoacetyl-CoA synthesis. atoB is classified under EC 2.3.1.9. Acetoacetyl-CoA can serve as the substrate for BHBD-catalyzed 3-hydroxybutanoyl-CoA synthesis. BHBD is classified under EC 1.1.1.157. 3-hydroxybutanoyl-CoA can serve as the substrate for ECH-catalyzed trans-but-2-enoyl-CoA synthesis. ECH is classified under EC 4.2.1.17. Trans-but-2-enoyl-CoA can serve as the substrate for ECR-catalyzed butanoyl-CoA synthesis. ECR is classified under EC 1.3.8.1. Butanoyl-CoA can serve as the substrate for bktB-catalyzed 3-keto-hexanoyl-CoA synthesis. bktB is classified under EC 2.3.1.9. The bktB catalyzing the production of 3-ketohexanoyl CoA from butanoyl-CoA can be the same as, or different from, the atoB used to catalyze the production of acetoacetyl-CoA from acetyl-CoA. 3-ketohexanoyl-CoA is the substrate for BHBD-catalyzed 3-hydroxyhexanoyl-CoA synthesis. BHBD is classified under EC 1.1.1.157. The BHBD catalyzing the production of 3-hydroxyhexanoyl-CoA can be the same as, or different from, the BHBD used to catalyze the production of 3-hydroxybutanoyl-CoA. 3-hydroxyhexanoyl-CoA can be the substrate for ECH-catalyzed trans-hex-2-enoyl-CoA synthesis. ECH is classified under 4.2.1.17. The ECH catalyzing the production of trans-hex-2-enoyl-CoA can be the same as, or different from, the ECH used to catalyze the production of trans-but-2-enoyl-CoA. Trans-hex-2-enoyl-CoA can be the substrate for ECR-catalyzed hexanoyl-CoA synthesis. ECR is classified under EC 1.3.1.38 or EC 1.3.1.44. The ECR catalyzing the production of hexanoyl-CoA can be the same as, or different from, the ECR used to catalyze the production of butanoyl-CoA In some embodiments, a hexanoyl-CoA synthetase (HCS) enzyme can be substituted for the scaffolded enzymes of the hexanoyl-CoA pathway or can be included in a soluble form in addition to the scaffolded enzymes of the hexanoyl-CoA pathway, and in some embodiments, hexanoic acid can be added to the growth media as a substrate for HCS-catalyzed hexanoyl-CoA production. The HCS can be included on the scaffold, N-terminal to the upper cannabinoid pathway in FIGS. 1A and 1B, and/or it can be non-scaffolded (soluble).

In the embodiment shown in FIGS. 1A and 1B, the C-terminal mevalonate pathway can include an ACL, an atoB, a hydroxymethylglutaryl-CoA, an HMG-CoA synthase (HMGS), an HMG-CoA reductase (HMGR), a mevalonate kinase (ERG12), a phosphomevalonate kinase (ERG8), a diphospho mevalonate decarboxylase (MVD1), an isopentyl diphosphate isomerase (IDI1), and a mutant GPP synthase (mGPPS). In the mevalonate pathway shown in FIGS. 1A and 1B, citrate from cellular metabolism and/or supplemented in the growth medium, can be used as a substrate for ACL-catalyzed acetyl-CoA synthesis. ACL is classified under EC 2.3.3. Acetyl-CoA can be used as a substrate for bktB-catalyzed acetoacetyl-CoA synthesis. bktB is classified under EC 2.3.1.9. Acetoacetyl-CoA can be the substrate for HMGS-catalyzed HMG-CoA synthesis. HMG-CoA can be the substrate for HMGR catalyzed mevalonate synthesis. HMGR is classified under EC 1.1.1.88 or 1.1.1.34. Mevalonate can be the substrate for mevalonate kinase-catalyzed mevalonate-5 phosphate synthesis. Mevalonate kinase is classified under EC 2.7.1.36. Mevalonate-5-phosphate can be the substrate for phosphomevalonate kinase-catalyzed mevalonate pyrophosphate synthesis. Phosphomevalonate kinase is classified under EC 2.7.4.2.

Mevalonate pyrophosphate can be the substrate for diphosphomevalonate decarboxylase-catalyzed isopentyl pyrophosphate synthesis. Diphosphomevalonate decarboxylase is classified under EC 4.1.1.33. Isopentyl pyrophosphate can be the substrate for isopentyl diphosphate isomerase-catalyzed dimethylallyl pyrophosphate synthesis. Isopentyl diphosphate isomerase is classified under EC. 5.3.3.2. Dimethylallyl pyrophosphate can be the substrate for geranyl pyrophosphate synthase (GPPS)-catalyzed geranyl pyrophosphate synthesis. GPPS is classified under EC 2.5.1.1.

As acetyl-CoA can be the initial substrate for the hexanoyl-CoA, mevalonate/geranyl pyrophosphate, and malonyl-CoA cannabinoid precursor biosynthetic pathways, the inclusion of ACL at both the N-terminus and C-terminus of the multi-enzymatic scaffold in FIGS. 1A and 1B can directly couple the scaffolded pathways to cellular metabolism via ACL-catalyzed production of acetyl-CoA from citric acid cycle-derived citrate. The citrate also can be supplemented into the culture medium (e.g., as buffered citrate). In some embodiments, the ACL enzyme is included only at the N-terminus of the scaffold. In some embodiments, the ACL enzyme is included only at the C-terminus of the scaffold. In some embodiments, the ACL enzyme is included in soluble form.

Figure 5:
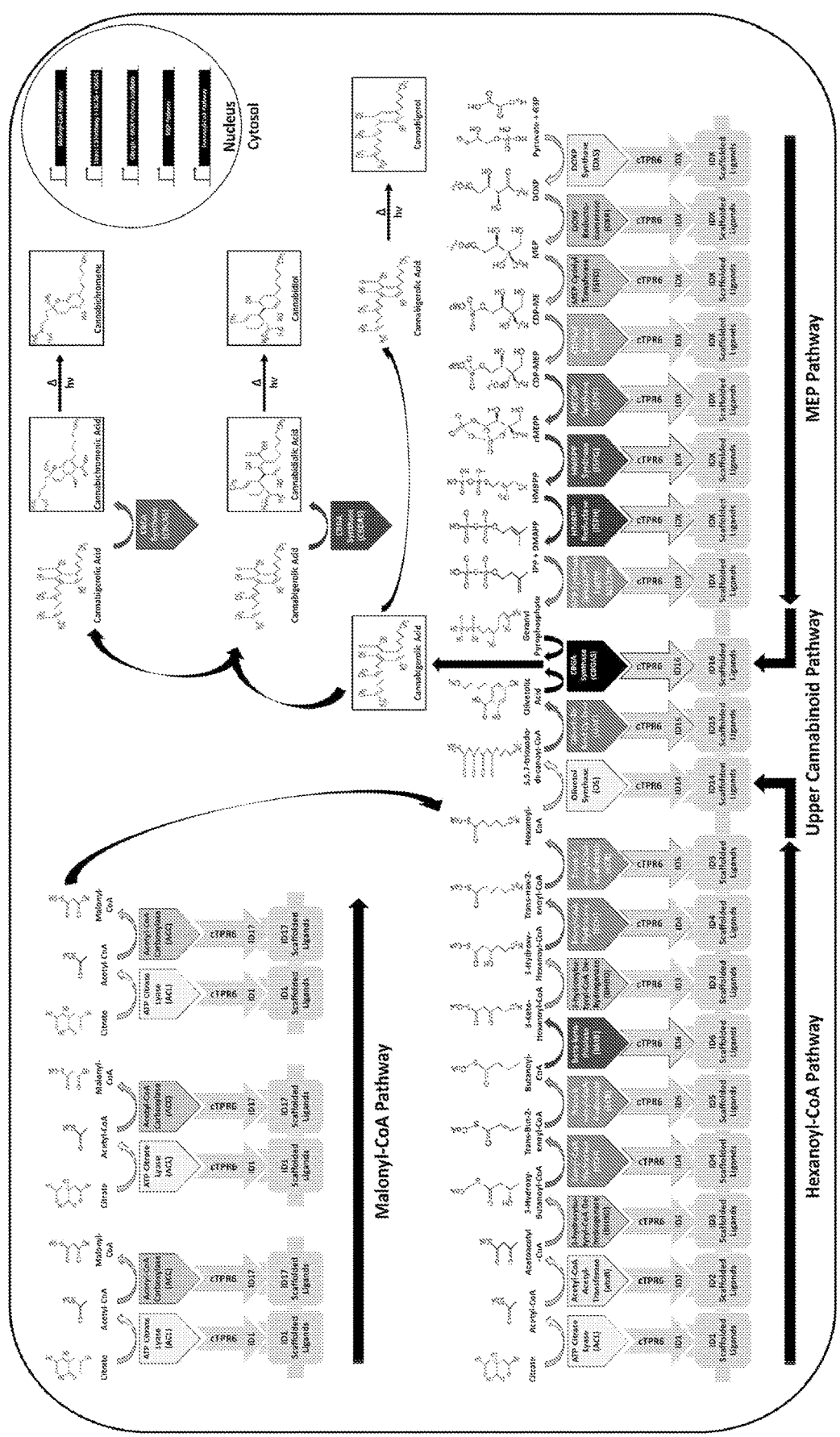
FIG. 5 is a schematic of one representative embodiment of a multi-enzymatic cannabinoidergic scaffold within a cell. The multi-enzymatic scaffold includes enzymes of the hexanoyl-CoA pathway, enzymes of the upper cannabinoid pathway, and enzymes of the MEP (2-C-methylerythritol 4-phosphate) pathway. The schematic also depicts a second scaffold according to one embodiment containing enzymes of the malonyl-CoA pathway and depicts a non-scaffolded CBDAS and a non-scaffolded CBCAS. ID refers to enzyme-linked interaction domain; cTPR6 refers to a spacer sequence; scaffolded ligands refer to the tandem peptide ligands that form the scaffold-binding sites specific for each enzyme-linked ID. The target products CBGA, CBG, CBDA, CBD, CBCA, and CBC are boxed for emphasis. CBG can be produced by decarboxylation of CBGA, CBD can be produced by decarboxylation of CBDA, and CBC can be produced by decarboxylation of CBCA. For each decarboxylation, the 'Δ' symbols represent heat and the 'hv' symbols represent light.

In some embodiments, the 2-C-methylerythritol 4-phosphate (MEP) pathway, which also can produce geranyl pyrophosphate, can be substituted for the scaffolded mevalonate pathway at the C-terminus of the scaffold or can be included in a soluble form in addition to the scaffolded mevalonate pathway. For example, as shown in FIG. 5, the C-terminus of the scaffold can include a 1-deoxy-D-xylulose-5-phosphate (DOXP) synthase, a DOXP reductoisomerase, a MEP cytidyl transferase, a 4-diphosphocytidyl-2-C-methylerythritol (CDPME) kinase, a 2-C-methyl-D-erythritol 2,4-cyclodiphosphate (MECDP) synthase, a 4-hydroxy-3-methyl-but-2-enyl pyrophosphate (HMBPP) synthase, a HMBPP reductase, and a GPPS. Pyruvate and glyceraldehyde-3-phosphate (G3P) can be used as substrates for DOXP-synthase-catalyzed DOXP synthesis. DOXP is classified under EC 2.2.1.7. DOXP can be the substrate for DOXP reductoisomerase (DXR)-catalyzed MEP synthesis. DXR is classified under EC 1.1.1.267. MEP can be the substrate for 2-C-methyl-D-erythritol 4-phosphate cytidylyltransferase (ISPD)-catalyzed 4-diphosphocytidyl-2-C-methylerythritol (CDP-ME) synthesis. ISPD is classified under EC 2.7.7.60. CDP-ME can be the substrate for 4-diphosphocytidyl-2-C-methyl-D-erythritol kinase (ISPE)-catalyzed 4-diphosphocytidyl-2-C-methyl-D-erythritol 2-phosphate (CDP-MEP) synthesis. ISPE is classified under EC 2.7.1.148. CDP-MEP can be the substrate for 2-C-methyl-D-erythritol 2,4-cyclodiphosphate synthase (ISPF)-catalyzed 2-C-methyl-D-erythritol 2,4-cyclodiphosphate (cMEPP) synthesis. ISPF is classified under EC 4.6.1.12. cMEPP can be the substrate for HMB-PP synthase (ISPG)-catalyzed (E)-4-Hydroxy-3-methyl-but-2-enyl pyrophosphate (HMBPP) synthesis. ISPG is classified under EC 1.17.7.1. HMBPP can be the substrate for 4-hydroxy-3-methylbut-2-enyl diphosphate reductase (ISPH)-catalyzed isopentenyl pyrophosphate (IPP) and dimethylallyl pyrophosphate (DMAPP) synthesis. ISPH is classified under EC 1.17.1.2. IPP and DMAPP can be substrates for GPPS-catalyzed geranyl pyrophosphate synthesis. GPPS is classified under EC 2.5.1.1.

In some embodiments, the mevalonate pathway can be substituted for the scaffolded MEP pathway at the C-terminus of the scaffold or can be included in a soluble form in addition to the scaffolded MEP pathway.

In the embodiment shown in FIG. 1A and FIG. 1B, a second multi-enzymatic scaffold can be co-expressed to enhance cytosolic titers of malonyl-CoA, another secondary substrate which can be used in cannabinoid biosynthesis. Such a scaffold can include an ATP citrate lyase (ACL) and acetyl-CoA carboxylase (ACC) in tandem. In some embodiments, the ACL and ACC are paired in duplicate or triplicate along the scaffold. If the ACL and ACC are paired in duplicate or triplicate, the two or three ACLs on the scaffold can be the same or different, and the two or three ACCs can be the same or different. In any of the embodiments, malonyl-CoA can be supplemented into the growth media instead of, or in addition to, being supplied by a scaffolded malonyl-CoA pathway.

Figure 4:
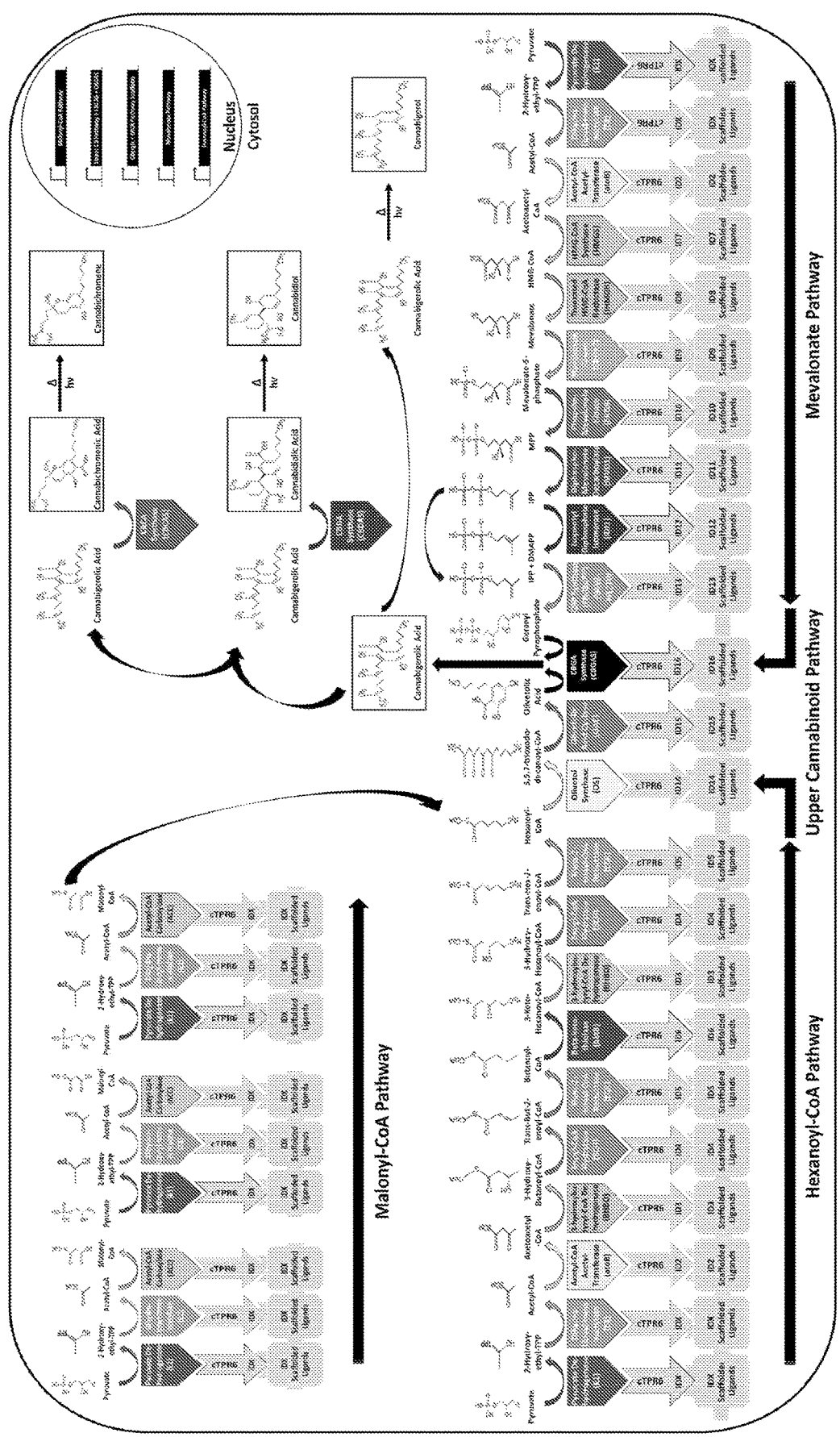
FIG. 4 is a schematic of one representative embodiment of a multi-enzymatic cannabinoidergic scaffold within a cell. The multi-enzymatic scaffold includes enzymes of the hexanoyl-CoA pathway, enzymes of the upper cannabinoid pathway, and enzymes of the mevalonate pathway. The schematic also depicts a second scaffold according to one embodiment containing enzymes of the malonyl-CoA pathway and depicts a non-scaffolded CBDAS and a non-scaffolded CBCAS. Pyruvate dehydrogenase (E1) and dihydrolipoyl transacetylase (E2) are substituted for ATP citrate lyase in both of the depicted scaffolds. ID refers to enzyme-linked interaction domain; cTPR6 refers to a spacer sequence; scaffolded ligands refer to the tandem peptide ligands that form the scaffold-binding sites specific for each enzyme-linked ID. The target products CBGA, CBG, CBDA, CBD, CBCA, and CBC are boxed for emphasis. CBG can be produced by decarboxylation of CBGA, CBD can be produced by decarboxylation of CBDA, and CBC can be produced by decarboxylation of CBCA. For each decarboxylation, the 'Δ' symbols represent heat and the 'hv' symbols represent light.

In any of the embodiments in which an ACL enzyme is used, a pyruvate dehydrogenase (E1) and a dihydrolipoyl transacetylase (E2) can be substituted for the ACL. For example, as shown in FIG. 4, a pyruvate dehydrogenase (E1) and a dihydrolipoyl transacetylase (E2) can be substituted upstream of scaffolded mevalonate, hexanoyl-CoA, and malonyl-CoA pathways. Using both a pyruvate dehydrogenase (E1) and a dihydrolipoyl transacetylase can allow acetyl-CoA to be produced using pyruvate rather than citrate as the primary substrate. In such embodiments, pyruvate also can be supplemented in the growth media. Pyruvate dehydrogenases and dihydrolipoyl transacetylases are constituents of the multi-enzyme pyruvate dehydrogenase complex that catalyze acetyl-CoA production from pyruvate. E1 and E2 are found in bacteria and eukaryotes.

As shown in FIG. 1A and FIG. 1B, the co-scaffolded upper cannabinoid pathway can include an olivetol synthase (OS), an olivetolic acid cyclase (OAC), and an aromatic prenyl-transferase (APT) such as a CBGA synthase (CBGAS). The upper cannabinoid pathway can begin using hexanoyl-CoA and three malonyl CoAs as the substrate for olivetol synthase-catalyzed 3,5,7-trioxododecanoyl-CoA synthesis. Olivetol synthase is classified under EC 2.3.1.206. 3,5,7-trioxododecanoyl-CoA can be used as a substrate for OAC-catalyzed olivetolic acid synthesis. OAC is classified under EC 4.4.1.26.

At the flux intersection of the converging N-terminal hexanoyl-CoA/upper cannabinoid and C-terminal mevalonate/MEP pathways (near the scaffold midpoint), an APT such as CBGAS can use olivetolic acid from the hexanoyl-CoA/upper cannabinoid pathways and geranyl pyrophosphate from the mevalonate or MEP pathway as substrates for cannabigerolate synthesis. A suitable APT is classified under EC 2.5.1.102.

Figure 7:
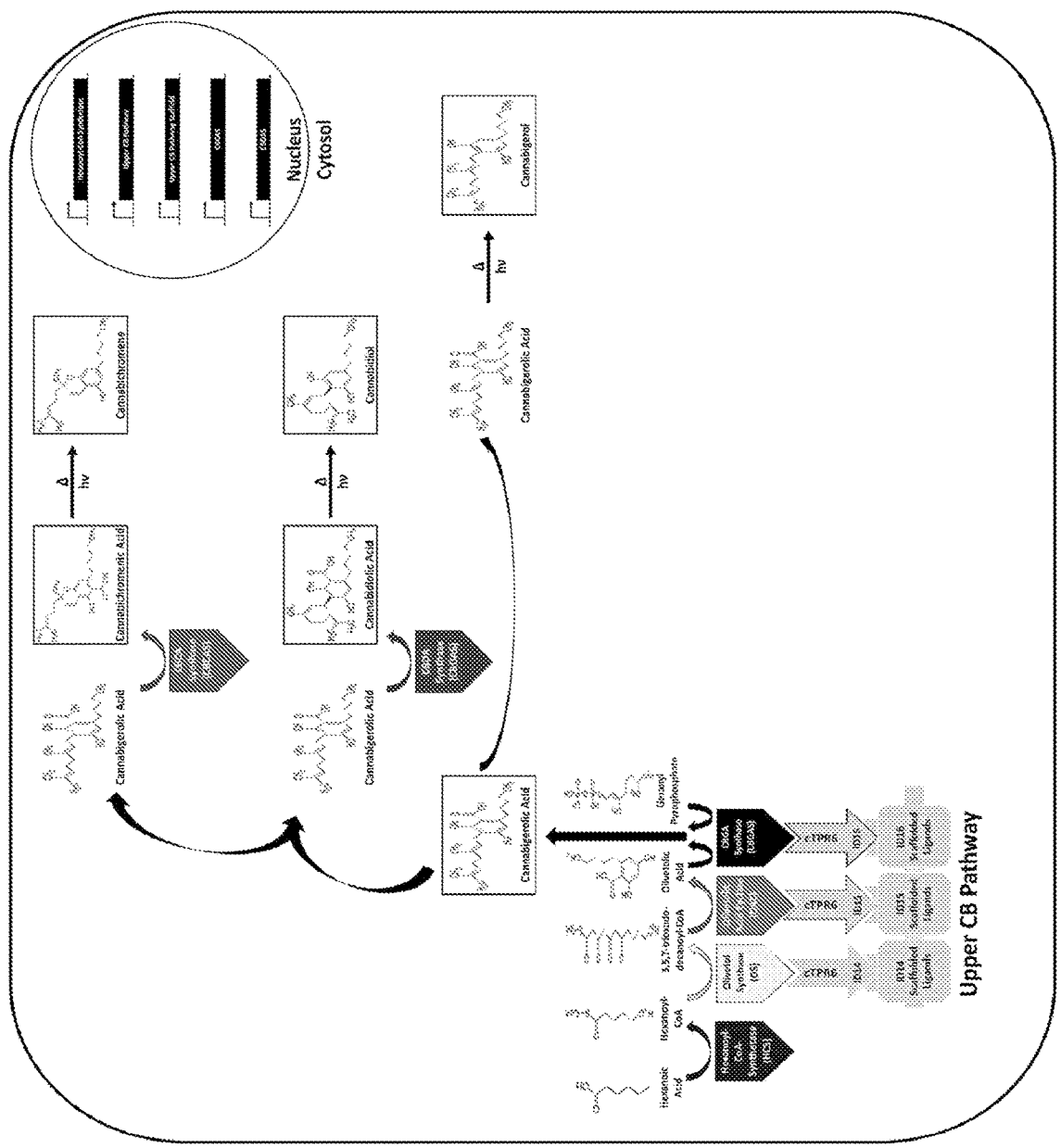
FIG. 7 is a schematic of one representative embodiment of a scaffold with the minimal requirements for cannabigerolic acid synthesis. The scaffold contains enzymes of the upper cannabinoid pathway. In this embodiment, a non-scaffolded hexanoyl-CoA synthetase (HCS), a non-scaffolded CBDAS, and a non-scaffolded CBCAS also are used. ID refers to enzyme-linked interaction domain; cTPR6 refers to a spacer sequence; scaffolded ligands refer to the tandem peptide ligands that form the scaffold-binding sites specific for each enzyme-linked ID. The target products CBGA, CBG CBDA, CBD, CBCA, and CBC are boxed for emphasis. CBG can be produced by decarboxylation of CBGA, CBD can be produced by decarboxylation of CBDA, and CBC can be produced by decarboxylation of CBCA. For each decarboxylation, the 'Δ' symbols represent heat and the 'hv' symbols represent light.

In some embodiments, enzymes in the upper cannabinoid pathway can be scaffolded with a hexanoyl-CoA synthetase (HCS) to biosynthesize cannabigerolate. In some embodiments, a soluble HCS can be used with scaffolded enzymes of the upper cannabinoid pathway to biosynthesize cannabigerolate as shown in FIG. 7. Suitable enzymes for the upper cannabinoid pathway are described above.

Figure 8:
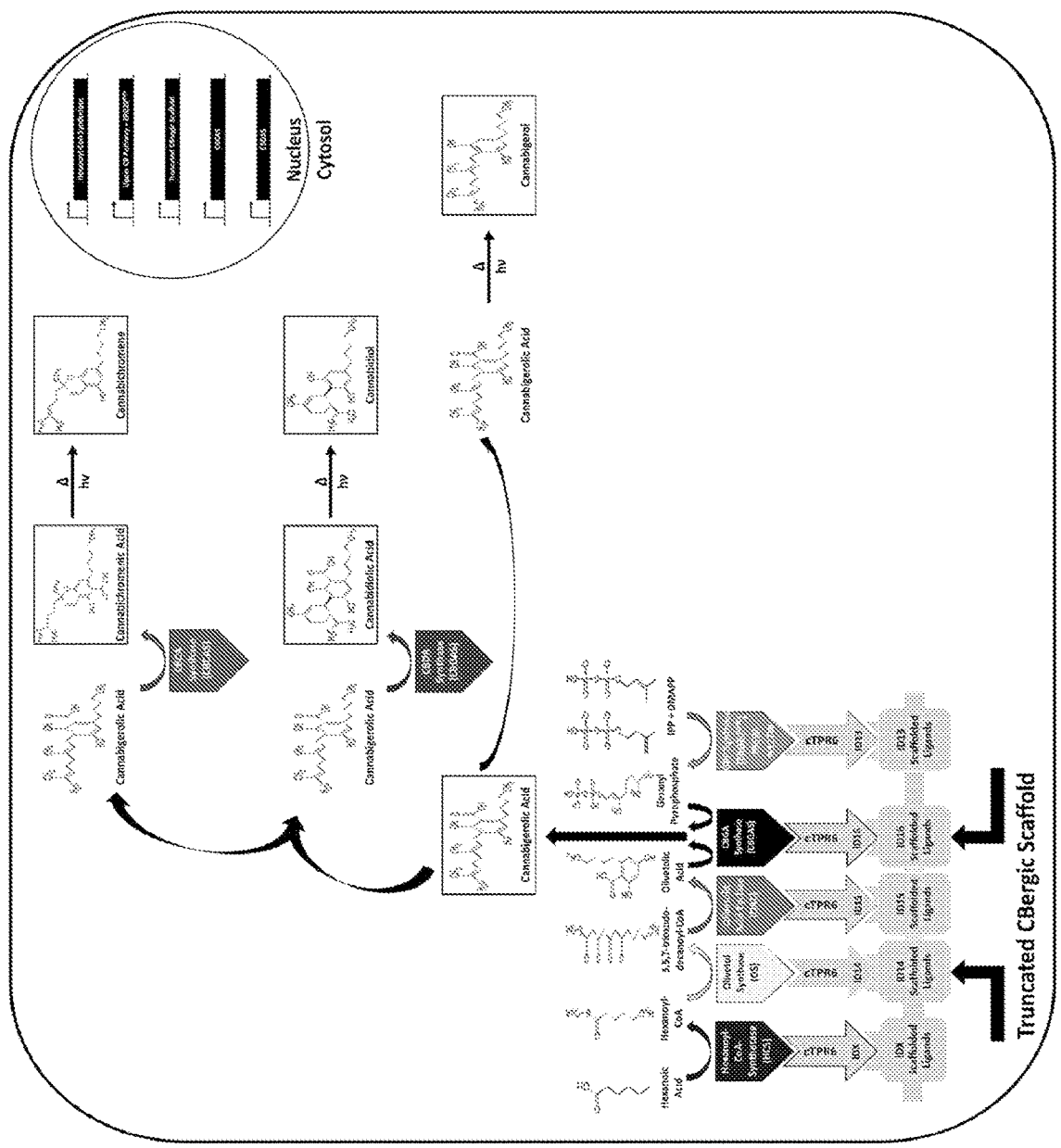
FIG. 8 is a schematic of one representative embodiment of a bi-directional scaffold containing a HCS on the N-terminus of the scaffold, a geranyl pyrophosphate synthase (GPPS) on the C-terminus of the scaffold, and the enzymes of the upper cannabinoid pathway between the HCS and GPPS. In this embodiment, a non-scaffolded CBDAS and a non-scaffolded CBCAS also can be used. ID refers to enzyme-linked interaction domain; cTPR6 refers to a spacer sequence; scaffolded ligands refer to the tandem peptide ligands that form the scaffold-binding sites specific for each enzyme-linked ID. The target products CBGA, CBG CBDA, CBD, CBCA, and CBC are boxed for emphasis. CBG can be produced by decarboxylation of CBGA, CBD can be produced by decarboxylation of CBDA, and CBC can be produced by decarboxylation of CBCA. For each decarboxylation, the 'Δ' symbols represent heat and the 'hv' symbols represent light.

In some embodiments, a minimal bidirectional scaffold, such as the one depicted in FIG. 8, can be used in which HCS is on the N-terminus of the scaffold, a GPPS is on the C-terminus of the scaffold, and enzymes in the upper cannabinoid pathway are scaffolded between the HCS and GPPS.

Figure 9:
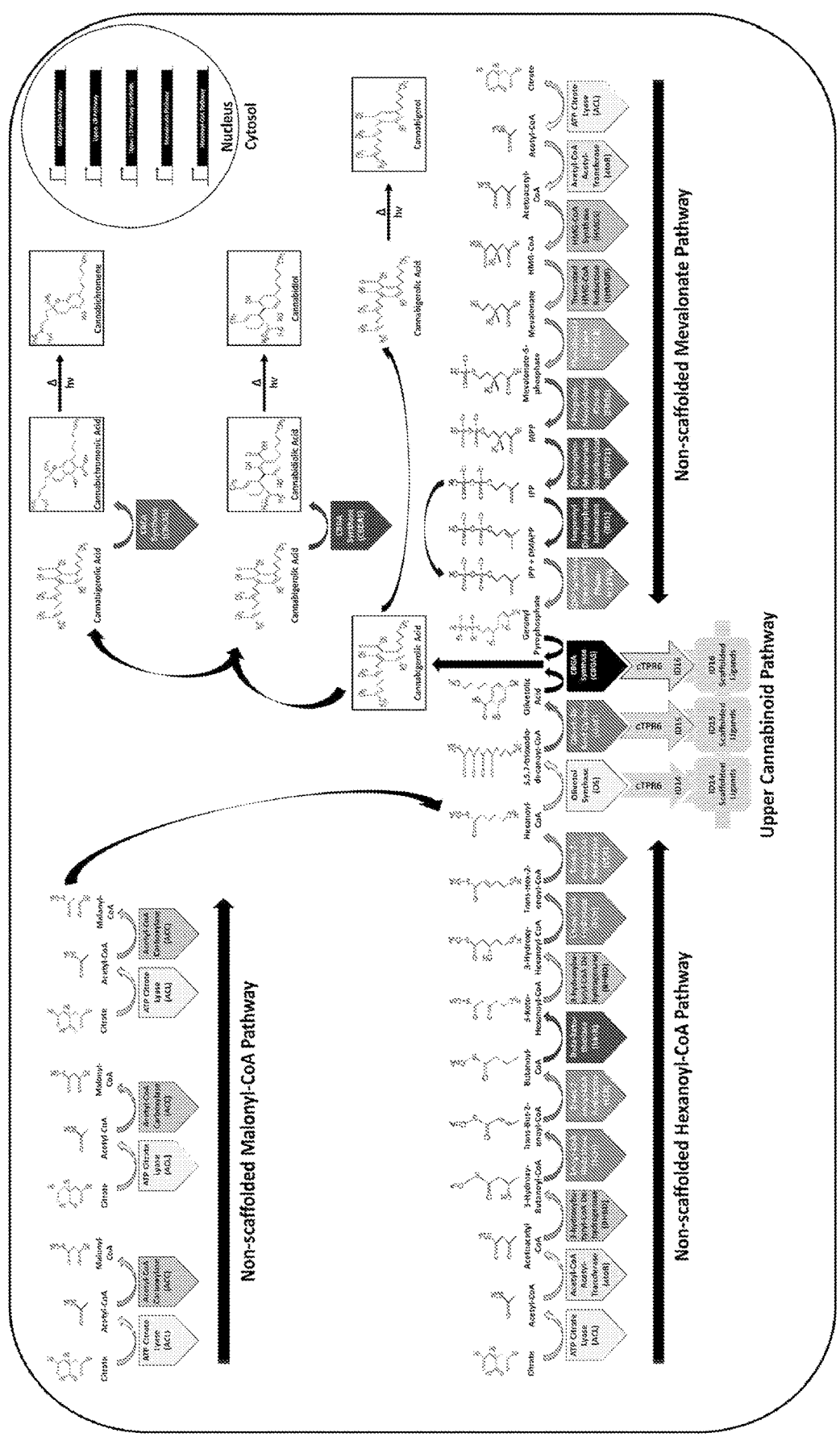
FIG. 9 is a schematic of one representative embodiment of a unidirectional scaffold containing enzymes of the upper cannabinoid pathway, shown with soluble enzymes from the precursor pathways (hexanoyl-CoA pathway, mevalonate pathway, and malonyl-CoA pathway), and soluble CBDAS and CBCAS. ID refers to enzyme-linked interaction domain; cTPR6 refers to a spacer sequence; scaffolded ligands refer to the tandem peptide ligands that form the scaffold-binding sites specific for each enzyme-linked ID. The target products CBGA, CBQ CBDA, CBD, CBCA, and CBC are boxed for emphasis. CBG can be produced by decarboxylation of CBGA, CBD can be produced by decarboxylation of CBDA, and CBC can be produced by decarboxylation of CBCA. For each decarboxylation, the 'A' symbols represent heat and the 'hv' symbols represent light.

In some embodiments, such as the embodiment shown in FIG. 9, the enzymes in the upper cannabinoid pathway can be scaffolded, while the enzymes in the hexanoyl-CoA pathway, enzymes in the mevalonate pathway, and enzymes in the malonyl-CoA pathway can be soluble. In some embodiments, the enzymes in the upper cannabinoid pathway can be scaffolded, while the enzymes in the hexanoyl-CoA pathway, enzymes in the MEP pathway, and enzymes in the malonyl-CoA pathway can be soluble. In such so embodiments, HCS can be substituted for the soluble forms of the enzymes of the hexanoyl-CoA pathway. Suitable enzymes for each of these pathways are described above.

In some embodiments, the enzymes in the upper cannabinoid pathway can be scaffolded, while a hexanoyl-CoA synthase, enzymes in the mevalonate or MEP pathway, and enzymes in the malonyl-CoA pathway can be soluble. Suitable enzymes for each of these pathways are described above.

In some embodiments, a HCS can be scaffolded N-terminally relative to the scaffolded enzymes in the upper cannabinoid pathway, while enzymes in the mevalonate or MEP pathway, and enzymes in the malonyl-CoA pathway can be soluble. Suitable enzymes for each of these pathways are described above.

In some embodiments, the enzymes in the upper cannabinoid pathway can be scaffolded, while the enzymes in the hexanoyl-CoA pathway or a hexanoyl-CoA synthase and enzymes in the mevalonate or MEP pathways can be soluble. In some embodiments, the enzymes in the hexanoyl-CoA pathway or a hexanoyl-CoA synthase can be scaffolded N-terminal to the enzymes in the upper cannabinoid pathway, and enzymes in the mevalonate or MEP pathways can be soluble. In such embodiments, malonyl-CoA can be supplemented. Suitable enzymes for each of these pathways are described above.

Figure 10:
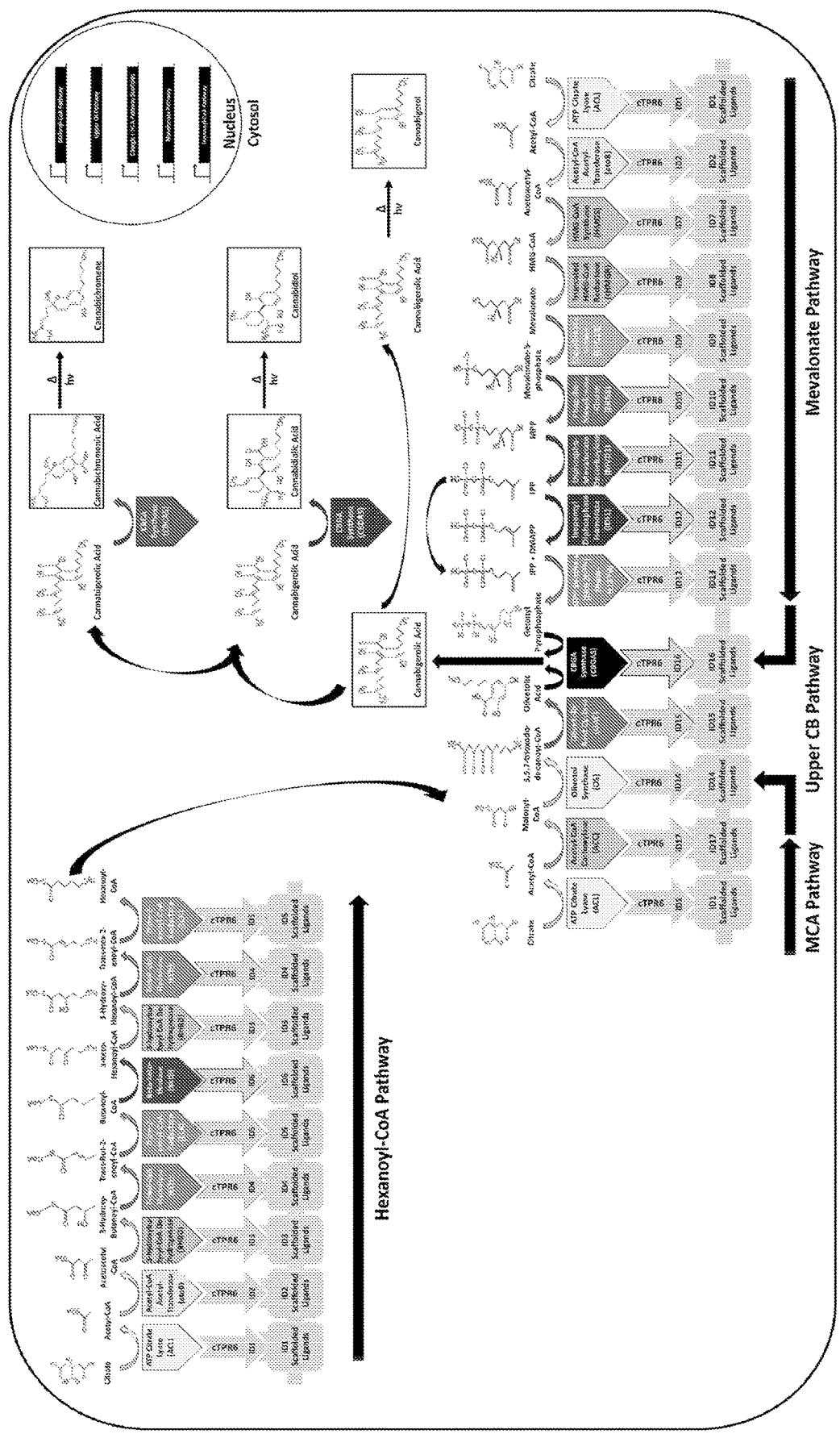
FIG. 10 is a schematic of one representative embodiment of a multi-enzymatic cannabinoidergic scaffold within a cell. The multi-enzymatic scaffold includes enzymes of the malonyl-CoA (MCA) pathway, enzymes of the upper cannabinoid pathway, and enzymes of the mevalonate pathway. The schematic also depicts a separate scaffold according to one embodiment containing enzymes of the hexanoyl-CoA pathway and depicts a non-scaffolded CBDAS and a non-scaffolded CBCAS. ID refers to enzyme-linked interaction domain; cTPR6 refers to a spacer sequence; scaffolded ligands refer to the tandem peptide ligands that form the scaffold-binding sites specific for each enzyme-linked ID. The target products CBGA, CBG, CBDA, CBD, CBCA, and CBC are boxed for emphasis. CBG can be produced by decarboxylation of CBGA, CBD can be produced by decarboxylation of CBDA, and CBC can be produced by decarboxylation of CBCA. For each decarboxylation, the 'Δ' symbols represent heat and the 'hv' symbols represent light.

In some embodiments, such as the embodiment shown in FIG. 10, a bi-directional scaffold can include enzymes of the malonyl-CoA (MCA) pathway on the N-terminus of the scaffold, enzymes of the mevalonate pathway on the C-terminus of the scaffold, and enzymes in the upper cannabinoid pathway in between. In some embodiments, a bi-directional scaffold can include enzymes of the malonyl-CoA pathway on the N-terminus of the scaffold, enzymes of the MEP pathway on the C-terminus of the scaffold, and enzymes in the upper cannabinoid pathway in between. In such embodiments, enzymes of the hexanoyl-CoA pathway can be on a separate scaffold or can be soluble. In some embodiments, HCS can be substituted for scaffolded or soluble enzymes of the hexanoyl-CoA pathway.

In some embodiments, each of the pathways are on separate scaffolds. For example, in one embodiment, enzymes of the upper cannabinoid pathway can be on one scaffold, enzymes of the mevalonate or MEP pathway can be localized on one scaffold, enzymes of the hexanoyl-CoA pathway can be localized on one scaffold, and enzymes of the malonyl-CoA pathway can be localized on another scaffold.

Cannabigerolic acid biosynthesized in any of the embodiments described herein can be isolated and/or can be used as a substrate for synthesis of other secondary and tertiary cannabinoids using downstream cannabinoid synthases. In order to generate a more diverse profile of cannabinoids, the downstream cannabinoid synthases typically are not scaffolded, as scaffolding would favor production of the terminal cannabinoid. In some embodiments, however, one or more of the downstream cannabinoid synthases can be included on a scaffold described herein.

For example, one or more of cannabidiolic acid synthase (CBDAS), cannabichromenic acid synthase (CBCAS), tetrahydrocannabinolic acid synthase (THCAS), or other cannabinoid synthases can be used to produce additional cannabigerolate-derived cannabinoids. For example, a CBDAS; a CBCAS; a THCAS; a CBDAS and a CBCAS; a CBDAS and a THCAS; a CBCAS and a THCAS; or a CBDAS, CBCAS, and THCAS can be used to produce additional cannabigerolate-derived cannabinoids such as one or more of cannabiodiolic acid, cannabichromenic acid, and delta-9 tetrahydrocannabinolic acid. CBDAS is classified under EC 1.21.3.8 and can catalyze the synthesis of cannabidiolic acid from cannabigerolic acid. CBCAS is classified under EC 1.3.3- and can catalyze the synthesis of cannabichromenic acid from cannabigerolic acid. THCAS is classified under EC 1.21.3.7 and can catalyze the synthesis of delta-9 tetrahydrocannabinolic acid from cannabigerolic acid.

Host cells for Producing Cannabinoids

Cannabinoids can be produced in host cells or in vitro using a multi-enzymatic scaffold as described herein. Suitable host cells include any microorganism, eukaryotic or prokaryotic, such as bacteria (e.g., *Escherichia coli, Bacillus, Brevibacterium, Streptomyces*, or *Pseudomonas*), yeast (e.g., *Pichia pastoris, Saccharomyces cerevisiae, Yarrowia lipolytica, Kluyveromyces marxiamus*, or *Komagataella phaffli*) and other fungi (e.g., *Neumrospora crassa*), and green algae (e.g., *Dunaliella* sp., *Chlorella variabilis, Euglena mutabilis*, or *Chlamydomonas reinhardtii*), as well as plant cells (e.g., tobacco, *Cannabis*, or other photosynthetic plant cells) that can be maintained in culture or, in the case of plant cells such as those from tobacco or cannabis plants, can be engineered in culture and cultivated as intact transgenic plants. Such host cells or plant may or may not naturally produce cannabinoids.

A host cell can be modified to contain one or more exogenous nucleic acids that encode a scaffold as described herein and one or more exogenous nucleic acids that encode the engineered enzymes. The term "nucleic acid" as used herein encompasses both RNA and DNA, including cDNA, genomic DNA, and synthetic (e.g., chemically synthesized) DNA. The nucleic acid can be double-stranded or single-stranded. Where single-stranded, the nucleic acid can be the sense strand or the antisense strand. In addition, nucleic acid can be circular or linear.

The term "exogenous" as used herein with reference to nucleic acid and a particular host cell refers to any nucleic acid that does not originate from that particular host cell as found in nature. Thus, non-naturally-occurring nucleic acid is considered to be exogenous to a host cell once introduced into the host cell. It is important to note that non-naturally-occurring nucleic acid can contain nucleic acid sequences or fragments of nucleic acid sequences that are found in nature provided the nucleic acid as a whole does not exist in nature. For example, a nucleic acid molecule containing a genomic DNA sequence within an expression vector is non-naturally-occurring nucleic acid, and thus is exogenous to a host cell once introduced into the host cell, since that nucleic acid molecule as a whole (genomic DNA plus vector DNA) does not exist in nature. Thus, any vector, autonomously replicating plasmid, or virus (e.g., retrovirus, adenovirus, or herpes virus) that as a whole does not exist in nature is considered to be non-naturally-occurring nucleic acid. It follows that genomic DNA fragments produced by PCR or restriction endonuclease treatment as well as cDNAs are considered to be non-naturally-occurring nucleic acid since they exist as separate molecules not found in nature. It also follows that any nucleic acid containing a promoter sequence and polypeptide-encoding sequence (e.g., cDNA or genomic DNA) in an arrangement not found in nature is non-naturally-occurring nucleic acid.

A nucleic acid that is naturally-occurring can be exogenous to a particular cell. For example, an entire chromosome isolated from a cell of organism X is an exogenous nucleic acid with respect to a cell of organism Y once that chromosome is introduced into Y's cell.

It is noted that a host cell can be given an exogenous nucleic acid molecule that encodes a polypeptide having an enzymatic activity that catalyzes the production of a compound not normally produced by that host cell. Alternatively, or additionally, a host cell can be given an exogenous nucleic acid molecule that encodes a polypeptide having an enzymatic activity that catalyzes the production of a compound that is normally produced by that host cell. In this case, the recombinant host cell can produce more of the compound, or can produce the compound more efficiently, than a similar host cell not having the genetic modification.

An enzyme having a particular enzymatic activity can be a polypeptide that is either naturally-occurring or non-naturally-occurring. A naturally-occurring polypeptide any polypeptide having an amino acid sequence as found in nature, including wild-type and polymorphic polypeptides. Such naturally-occurring polypeptides can be obtained from any species including, without limitation, animal (e.g., mammalian), plant, fungal, and bacterial species. A non-naturally-occurring polypeptide is any polypeptide having an amino acid sequence that is not found in nature. Thus, a non-naturally-occurring polypeptide can be a mutated version of a naturally-occurring polypeptide, or an engineered polypeptide such as the engineered enzymes described herein that contain IDs. For example, a non-naturally-occurring polypeptide having geranyl pyrophosphate synthase activity can be a mutated version of a naturally-occurring polypeptide having geranyl pyrophosphate synthase activity. For example, the GPPS encoded by Erg20 may include a substitution of a tryptophan for phenylalanine at position 96 and a substitution of a tryptophan for asparagine at position 127 (referred to as $Erg20^{WW}$). $Erg20^{WW}$ favors production of geranyl pyrophosphate over farnesyl pyrophosphate. See, Jiang, et al., *Metab Eng.* 2017, 41:57-66. For example, a truncated HMGR (tHMGR) such as an N-terminally truncated HMGR that includes the catalytic domain but not the transmembrane or regulatory domains of HMGR can be used. For example, the HMGR from *A. thaliana* (GenBank Accession No. J04537) or a HMGR from *S. cerevisiae* (which contains only residues 646-1025) can be truncated to remove the transmembrane and/or regulatory domains and used in a scaffold described herein to remove a bottleneck in the mevalonate pathway. HMGR catalyzes the rate-limiting step in the mevalonate pathway (see, e.g., Song et al., 2017, *Scientific reports*, doi:10.1038/s41598-017-15005-4). For example, the nucleic acid encoding an atoB from *S. cerevisiae* can be modified to contain a synthetic 5' UTR (such as the synthetic 5' UTR sequence: 5'-cggcaccctacaaacagaaggaatataaa-3' (SEQ ID NO:82)) and can be used in the scaffold as it alters atoB expression to facilitate flux-rebalancing in favor of production of acetoacetyl-CoA over the reverse reaction product butyryl-CoA (see Kim et al., 2018, *Bioresour Technol*, doi: 10.1016/j.biortech.2017.10.014). A polypeptide can be mutated by, for example, sequence additions, deletions, substitutions, or combinations thereof.

Any of the enzymes described herein that can be used to produce one or more cannabinoids can have at least 70% sequence identity (e.g., at least 75%, 80%, 85%, 90%, 95%, 97%, 98%, 99°%, or 100%) to the amino acid sequence of the corresponding wild-type enzyme. It will be appreciated that the sequence identity can be determined on the basis of the mature enzyme (e.g., with any signal sequence removed).

For example, an ACL can have at least 70% sequence identity (e.g., at least 75%, 80%, 85%, 90%, 95%, 97%, 98%, 99%, or 100%) to the amino acid sequence of a *Homo sapiens* ACL (see SEQ ID NO:83, FIG. 6A), or an ACL from *Rattus norvegicus, Mus musculus*, or *Ciona intestinalis*, e.g., GenBank Accession Nos. AAA74463, AAK56081, and BAB00624, respectively.

For example, an acetyl-CoA acetyltransferase (atoB) can have at least 70% sequence identity (e.g., at least 75%, 80%, 85%, 90%, 95%, 97%, 98%, 99%, or 100%) to the amino acid sequence of an *Escherichia coli* atoB (see SEQ ID NO:84, FIG. 6A), or an atoB from (*Cupriavidus necator, Clostridium acetobutylicum*, or *Arabidopsis thaliana*, e.g., GenBank Accession Nos. CAJ92573, AAK80816, and AAM67058, respectively. In some embodiments, a malonyl-CoA acyl carrier protein transacylase from *Saccharomyces cerevisiae, Homo sapiens, Serratia plymuthica*, or *Dickeya paradisiaca* can be substituted for atoB, e.g., GenBank Accession Nos. DAA10992, AAH30985, AGO55277, and ACS85236, respectively.

For example, a 3-hydroxy-butyryl-CoA dehydrogenase (BHBD) can have at least 70% sequence identity (e.g., at least 75%, 80%, 85%, 90%, 95%, 97%, 98%, 99%, or 100%0) to the amino acid sequence of a *Clostridium acetobutylicum* BHBD (see SEQ ID NO:85, FIG. 6A), or a BHBD from *Escherichia coli, Treponema denlicola*, or *Arabidopsis thaliana*, e.g., GenBank Accession Nos. AIZ91493, AAS11105, and AAN17431, respectively.

For example, an enoyl-CoA hydratase (ECH) can have at least 70% sequence identity (e.g., at least 75%, 80%, 85%, 90%, 95%, 97%, 98%, 99%, or 100%) to the amino acid sequence of a *Clostridium acetobutylicum* ECH (see SEQ ID NO:86, FIG. 6A), or an ECH from *Acinetobacter oleivorans, Cupriavidus necator*, or *Acinetobacter baumannii*, e.g., GenBank Accession Nos. ADI91469, CAJ91294, and ACJ57023, respectively.

For example, a beta-ketothiolase (bktB) can have at least 70% sequence identity (e.g., at least 75%, 80%, 85%, 90%, 95%, 97%, 98%, 99%, or 100%) to the amino acid sequence of a *Cupriavidus necator* bktB (see SEQ ID NO:87, FIG. 6A), or a bktB from *Escherichia coli, Lactobacillus casei*, or *Clostridium acetobutylicum*, e.g., GenBank Accession Nos. ALI39443, CAQ67083, and AAKS0816, respectively.

For example, a trans-2-enoyl-CoA-reductase (ECR) can have at least 70% sequence identity (e.g., at least 75%, 80%, 85%, 90%, 95%, 97%, 98%, 99%, or 100%) to the amino acid sequence of a *Treponema denticola* ECR (see SEQ ID NO:88, FIG. 6A), or an ECR from *Cupriavidus necator, Saccharomyces cerevisiae*, or *Klebsiella michiganensis*, e.g., GenBank Accession Nos. AAP86010, DAA07148, and AIE72439, respectively.

For example, a hexanoyl-CoA synthetase (HCS), which is a type of acyl-activating enzyme (AAE), can have at leas t70% sequence identity (e.g., at least 75%, 80%, 85%, 90%, 95%, 97%, 98%, 99%, or 100%) to the amino acid sequence of a *C. sativa* AAE1 (see SEQ ID NO:89, FIG. 6A, GenBank Accession No. AFD33345) or *C. sativa* AAE3 (GenBank Accession No. AFD33347). The *C. sativa* AAE1 and AAE3 each can use hexanoate as a substrate. See, Stout, et al., *Plant J.* 71(3): 353-365 (2012). In some embodiments, the AAE encoded by CsAAE1 can be used. See, GenBank Accession No. JN717233 for the coding sequence. In some embodiments, the AAE encoded by CsAAE3 can be used. See, GenBank Accession No. JN717233 for the coding sequence. In some embodiments, both CsAAE1 and CsAAE3 can be used.

For example, an HMG-CoA synthase (HMGS) can have at least 70% sequence identity (e.g., at least 75%, 80%, 85%, 90%, 95%, 97%, 98%, 99%, or 100%) to the amino acid sequence of a *S. cerevisiae* HMGS (see SEQ ID NO:90, FIG. 6A), or an HMGS from *Arabidopsis thaliana, Lactobacillus casei*, or *Homo sapiens*, e.g., GenBank Accession Nos. AEE83052, CAQ67081, and AAA62411, respectively.

For example, an HMG-CoA reductase (HMGR), N-terminally truncated or canonical, can have at least 70% sequence identity (e.g., at least 75%, 800/0, 85%, 90%, 95%, 97%, 98%, 99%, or 100%) to the amino acid sequence of a *S. cerevisiae* HMGS (see SEQ ID NO:91, FIG. 6A), or an HMGR from *Arabidopsis thaliana, Lactobacillus casei*, or *Homo sapiens*, e.g., GenBank Accession Nos. AEE35849, CAQ67082, and AAA52679, respectively.

For example, a mevalonate kinase can have at least 70% sequence identity (e.g., at least 750%, 80%, 85%, 90%, 95%, 97%, 98%, 99%, or 100%) to the amino acid sequence of a *S. cerevisiae* mevalonate kinase (see SEQ ID NO:92, FIG. 6A), or a mevalonate kinase from *Arabidopsis thaliana, Lactobacillus casei*, or *Homo sapiens*, e.g., GenBank Accession Nos. AAD31719, CAQ66794, and AAF82407, respectively.

For example, a phosphomevalonate kinase can have at least 70% sequence identity (e.g., at least 75%, 80%, 85%, 90%, 95%, 97%, 98%, 99%, or 100%) to the amino acid sequence of a *S. cerevisiae* phosphomevalonate kinase (see SEQ ID NO:93, FIG. 6A), or a mevalonate kinase from *Scheffersomyces stipitis, Lactobacillus casei*, or *Homo sapiens*, e.g., GenBank Accession Nos. EAZ63544, CAQ66339, and AAH06089, respectively.

For example, a diphosphomevalonate decarboxylase can have at least 70% sequence identity (e.g., at least 75%, 80%, 85%, 90%, 95%, 97%, 98%, 99%, or 100%) to the amino acid sequence of a *S. cerevisiae* diphosphomevalonate decarboxylase (see SEQ ID NO:94, FIG. 6A), or a diphosphomevalonate decarboxylase from *Arabidopsis thaliana, Lactobacillus casei*, or *Homo sapiens*, e.g., GenBank Accession Nos. AAC67348, CAQ66795, and AAC50440, respectively.

For example, an isopentyl diphosphate isomerase can have at least 70% sequence identity (e.g., at least 75%, 80%, 85%, 90%, 95%, 97%, 98%, 99%, or 100%) to the amino acid sequence of a *S. cerevisiae* isopentyl diphosphate isomerase (see SEQ ID NO:95, FIG. 6A), or an isopentyl diphosphate isomerase from *Arabidopsis thaliana, Lactobacillus casei*, or *Homo sapiens*, e.g., GenBank Accession Nos. AAC49920, CAQ66796, and AAP35407, respectively.

For example, a geranyl pyrophosphate synthase (GPPS) (also known as a geranyl-diphospate synthase) can have at least 70% sequence identity (e.g., at least 75%, 80%, 85%, 90%, 95%, 97%, 98%, 99%, or 100%) to the amino acid sequence of the *S. cerevisiae* GPS or a GPPS from *Acinetobacter baumannii, Lacobacillus casei*, or *Homo sapiens*, e.g., GenBank Accession Nos. ACJ56139, CAQ66932, and AAH10004, respectively. In some embodiments, a mutant GPPS can be used. For example, the GPPS encoded by Erg20 may include a substitution of a tryptophan for phenylalanine at position 96 and a substitution of a tryptophan for asparagine at position 127 (referred to as Erg20$^{WW}$) (see SEQ ID NO:96, FIG. 6A). Erg20$^{WW}$ favors production of geranyl pyrophosphate over farnesyl pyrophosphate. See, Jiang, et al., *Metab Eng* 2017 41:57-66. In some cases, substituting a glutamic acid for lysine at position 179 of Erg20 (Erg20$^{K1799E}$) can be used to produce a GPPS that favors production of geranyl pyrophosphate. See, WO2016010827A1.

For example, a DOXP synthase can have at least 70% sequence identity (e.g., at least 75%, 80%, 85%, 90%, 95%, 97%, 98%, 99%, or 100%) to the amino acid sequence of an *Escherichia coli, Clostridium acetobutylicum, Treponema denticola*, or *Arabidopsis thaliana* DOXP synthase, e.g., GenBank Accession Nos. CDH63925, AAK80036, AAS12424, and ANM65835, respectively.

For example, a DOXP reductoisomerase can have at least 70% sequence identity (e.g., at least 75%, 80%, 85%, 90%, 95%, 97%, 98%, 99%, or 100%) to the amino acid sequence of an *Escherichia coli, Clostridium acetobutylicum, Treponema denticola*, or *Arabidopsis thaliana* DOXP reductoisomerase, e.g., GenBank Accession Nos. CDH63708, AAK79760, AAS12860, and AAM61343, respectively.

For example, a MEP cytidyl transferase can have at least 70% sequence identity (e.g., at least 75%, 80%, 85%, 90%, 95%6, 97%, 98%6, 99%0, or 100%) to the amino acid sequence of an *Escherichia coli, Clostridium acetobutylicum, Treponema denticola*, or *Arabidopsis thaliana* MEP cytidyl transferase, e.g., GenBank Accession Nos. CDH66380, AAK81121, AAS12810, and BAB21592, respectively.

For example, a CDPME kinase can have at least 70% sequence identity (e.g., at least 75%, 80%, 85%, 90%, 95%, 97%, 98%, 99%, or 100%) to the amino acid sequence of an *Escherichia coli, Clostridium acetobutylicum, Treponema denticola*, or *Arabidopsis thaliana* CDPME kinase, e.g., GenBank Accession Nos. CDH64802, AAK80844, AAS11855, and AEC07908, respectively.

For example, a MECDP synthase can have at least 70% sequence identity (e.g., at least 75%, 80%, 85%, 90%, 95%, 97%, 98%, 99%, or 100%) to the amino acid sequence of an *Escherichia coli, Nicotiana tabacum, Treponema denticola*, or *Acinetobacter baumannii* MECDP synthase, e.g., GenBank Accession Nos. CDH66379, AHM22925, AAS12811, and ACJ59227, respectively.

For example, an HMBPP synthase can have at least 70% sequence identity (e.g., at least 75%, 80%, 85%, 90%, 95%, 97%, 98%, 99%, or 100%) to the amino acid sequence of an *Escherichia coli, Acinetobacter baumanii, Treponema denticola*, or *Arabidopsis thaliana* HMBPP synthase, e.g., GenBank Accession Nos. AAN81487, ACJ58210, AAS11783, and AED97354, respectively.

For example, an HMBPP reductase can have at least 70% sequence identity (e.g., at least 75%, 80%, 85%, 90%, 95%, 97%, 98%, 99%, or 100%) to the amino acid sequence of an *Escherichia coli, Acinetobacter baumannii, Treponema denticola*, or *Arabidopsis thaliana* HMBPP reductase, e.g., GenBank Accession Nos. CDH63564, ACJ57384, AAS11585, and AEE86362, respectively.

For example, an acetyl-CoA carboxylase (ACC) can have at least 70% sequence identity (e.g., at least 75%, 80%, 85%, 90%, 95%, 97%, 98%, 99%, or 100%) to the amino acid sequence of a *S. cerevisiae* acetyl-CoA carboxylase (see SEQ ID NO:97, FIG. 6A), or an acetyl-CoA carboxylase from *Homo sapiens, Treponema denticola*, or *Cupriavidus necator*, e.g., GenBank Accession Nos. AAP94122, AAS11086, and CAQ67359, respectively.

For example, a pyruvate dehydrogenase (E1) and dihydrolipoyl transacetylase (E2) can have at least 700 sequence identity (e.g., at least 75%, 80%, 85%, 90%, 95%, 97%, 98%, 99%, or 100%) to the amino acid sequence of a *Saccharomyces cerevisiae, Escherichia coli, Clostridium acetobutylicum*, or *Cupriavidus necator* E1 and E2, e.g., GenBank Accession Nos. DAA07337, AMC97367, CAQ66617, and CAJ92510 for E1, and DAA10474, AUG14916, CAQ66619, and CAJ92511 for E2, respectively.

For example, an olivetol synthase (OS) can have at least 70% sequence identity (e.g., at least 75%, 80%, 85%, 90%, 95%, 97%, 98%, 99%, or 100%) to the amino acid sequence of an OS from *C. sativa* set forth in SEQ ID NO:98 (FIG. 6A) or the OS from *C. sativa* having GenBank Accession No. BAG14339. See, for example, Taura, et al., *FEBS Letters* 583 (2009) 2061-2066.

For example, an olivetolic acid cyclase (OAC) can have at least 70% sequence identity (e.g., at least 75%, 800%, 85%, 90%, 95%, 97%, 98%, 99%, or 100%) to the amino acid sequence of an OAC from *C. sativa* set forth in SEQ ID NO:99 (FIG. 6A) or the OAC from *C. sativa* having GenBank Accession No. AFN42527. See, for example, Gagne, et al., *Proc. Natl. Acad. Sci. USA*, 2012 109 (31) 12811-12816.

For example, a CBGAS can have at least 70% sequence identity (e.g., at least 75%, 80%, 85%, 900, 95%, 97%, 98%, 99%, or 100%) to the amino acid sequence of an aromatic prenyl-transferase (APT) from *Cannabis sativa* such as the CBGAS set forth in SEQ ID NO: 100 (FIG. 6A). See, for example, U.S. Patent Publication No. 20120144523A1 and U.S. Pat. No. 8,884,100B2. In some embodiments, a soluble APT from *Streptomyces* (e.g., NphB) can be used. See, for example, Carvalho et al., *FEMS Yeast Research*, 17, 2017, fox037.

For example, a cannabidiolic acid synthase (CBDAS) can have at least 70% sequence identity (e.g., at least 75%, 80%, 85%, 90%, 95%, 97%, 98%, 99%, or 100%) to the amino acid sequence of a CBDAS from *C. sativa* set forth in SEQ ID NO:101 (FIG. 6A) or the amino acid sequence of a CBDAS from *C. sativa* having GenBank Accession No. BAF65033. See, for example, Taura, et al., *FEBS Lett.* 581 (16), 2929-2934 (2007).

For example, a cannabichromenic acid synthase (CBCAS) can have at least 70% sequence identity (e.g., at least 75%, 80%, 85%, 90%, 95%, 97%, 98%, 99%, or 100%) to the amino acid sequence of a CBCAS from *C. sativa* set forth in SEQ ID NO: 102 (FIG. 6A) or the amino acid sequence of a CBCAS from *C. sativa* as set forth in SEQ ID NO:2 of WO 2015/196275 A1. SEQ ID NO:2 of WO 2015/196275 A1 includes an N-terminal 28 amino acid signal peptide. All or a portion of the signal peptide can be removed from the sequence. The CBDAS from *C. indica* or *C. ruderalis* also can be used. In some embodiments, an *Escherichia coli* or yeast optimized nucleic acid sequence encoding a *C. sativa* CBCAS as set forth in SEQ ID NOs: 8 and 9, respectively, of WO 2015/196275 A1 can be used.

For example, a tetrahydrocannabinolic acid synthase (THCAS) can have at least 70% sequence identity (e.g., at least 75%, 80%, 85%, 90%, 95%, 97%, 98%, 99%, or 100%) to the amino acid sequence of a THCAS from *C. sativa* having GenBank Accession No. BAC41356. See, for example, Sirikantaramas, et al., *J. Biol. Chem.* 279 (38), 39767-39774 (2004).

The percent identity (homology) between two amino acid sequences can be determined as follows. First, the amino acid sequences are aligned using the BLAST 2 Sequences (Bl2seq) program from the stand-alone version of BLASTZ containing BLASTP version 2.0.14. This stand-alone version of BLASTZ can be obtained from Fish & Richardson's web site (e.g., www.fr.com/blast/) or the U.S. government's National Center for Biotechnology Information web site (www.ncbi.nlm.nih.gov). Instructions explaining how to use the Bl2seq program can be found in the readme file accompanying BLASTZ. Bl2seq performs a comparison between two amino acid sequences using the BLASTP algorithm. To compare two amino acid sequences, the options of Bl2seq are set as follows: -i is set to a file containing the first amino acid sequence to be compared (e.g., C:\seq1.txt); -j is set to a file containing the second amino acid sequence to be compared (e.g., C:\seq2.txt); -p is set to blastp; -o is set to any desired file name (e.g., C:\output.txt); and all other options are left at their default setting. For example, the following command can be used to generate an output file containing a comparison between two amino acid sequences: C:\Bl2seq-c:\seq1.txt-j c:\seq2.txt-p blastp-o c:\output.txt. If the two compared sequences share homology (identity), then the designated output file will present those regions of homology as aligned sequences. If the two compared sequences do not share homology (identity), then the designated output file will not present aligned sequences. Similar procedures can be following for nucleic acid sequences except that blastn is used.

Once aligned, the number of matches is determined by counting the number of positions where an identical amino acid residue is presented in both sequences. The percent identity (homology) is determined by dividing the number of matches by the length of the full-length polypeptide amino acid sequence followed by multiplying the resulting value by 100. It is noted that the percent identity (homology) value is rounded to the nearest tenth. For example, 78.11, 78.12, 78.13, and 78.14 is rounded down to 78.1, while 78.15, 78.16, 78.17, 78.18, and 78.19 is rounded up to 78.2. It also is noted that the length value will always be an integer.

It will be appreciated that a number of nucleic acids can encode a polypeptide having a particular amino acid sequence. The degeneracy of the genetic code is well known to the art; i.e., for many amino acids, there is more than one nucleotide triplet that serves as the codon for the amino acid. For example, codons in the coding sequence for a given enzyme can be modified such that optimal expression in a particular species (e.g., bacteria or fungus) can be attained, using appropriate codon bias tables for that species. For example, the nucleotide sequences set forth in FIG. 12A are the nucleic acid sequences encoding an ATP citrate lyase, an atoB, a 3-hydroxbutyryl-CoA dehydrogenase, an enoyl-CoA hydratase, a beto-ketothiolase (bktB), a trans-enoyl-CoA reductase, an HMG-CoA synthase, an HMG-CoA reductase, a mevalonate kinase, a phosphomevalonate kinase, a diphosphomevalonate decarboxylase, an isopentenyl-diphosphate delta isomerase, a geranyl-diphosphate synthase (ERG20$^{ww}$), an olivetol synthase, an olivetolic acid cyclase, a CBGA synthase, a CBDA synthase, a CBCA synthase, an acetyl-CoA carboxylase, and a hexanoyl-CoA synthetase. The nucleic acid sequences for the ATP citrate lyase, atoB, 3-hydroxybutyryl-CoA dehydrogenase, enoyl-CoA hydratase, trans-enoyl-CoA reductase, bktB, olivetol synthase, olivetolic acid cyclase, CBGA synthase, CBDA synthase, and CBCA synthase have been codon optimized for expression in yeast. FIGS. 14A-14C contain codon optimized (for expression in yeast) nucleic acid sequences encoding the engineered enzymes of FIGS. 13A-13C.

In addition to sequence similarity, it will be appreciated that enzymes and scaffolds with structural and/or functional similarity to the enzymes and scaffolds described herein are also encompassed within the scope of the document.

Figure 2A:
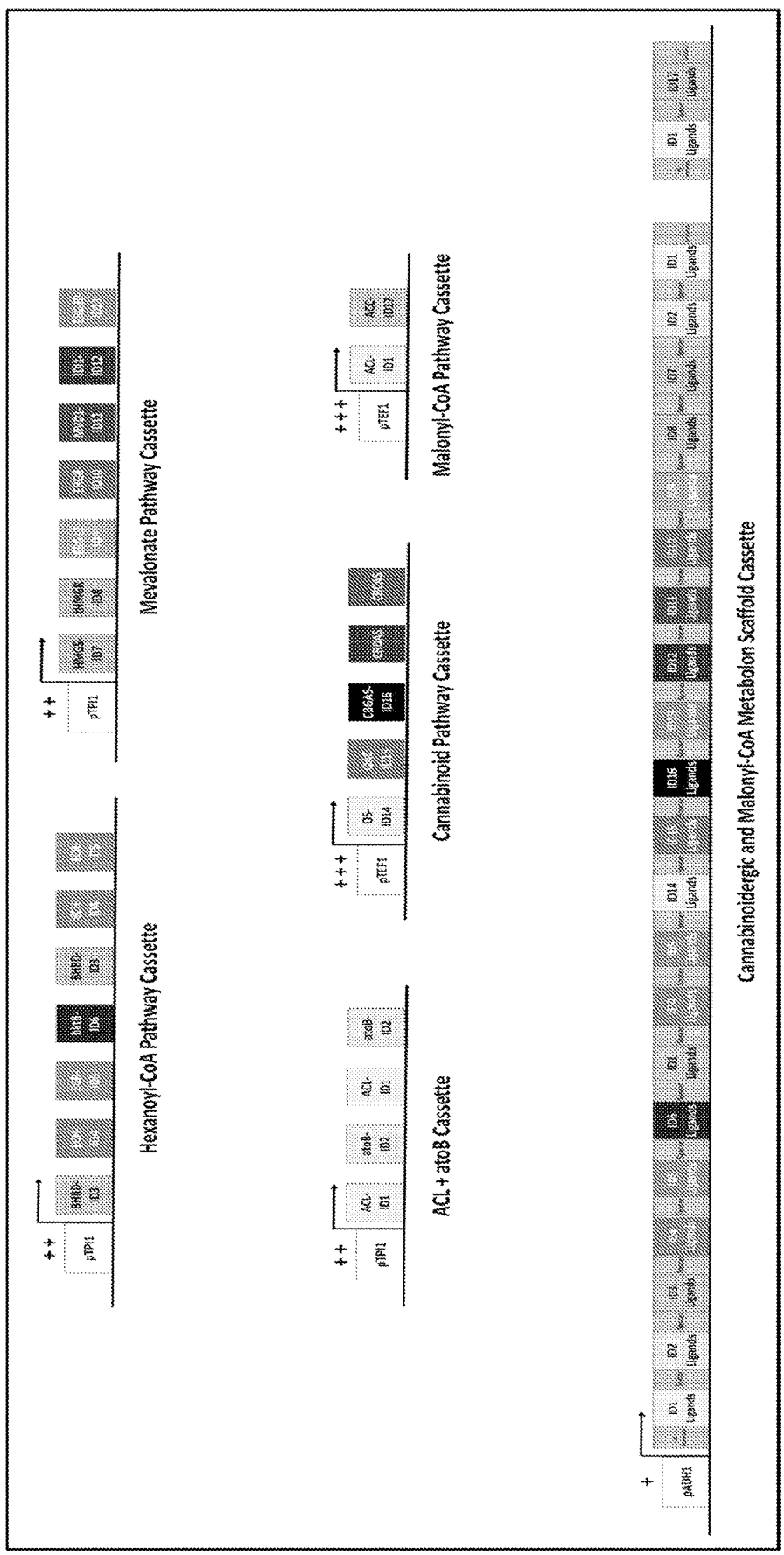
FIG. 2A is a schematic of gene cassettes according to one embodiment for the engineering of cannabinoidergic cells.
Figure 2B:
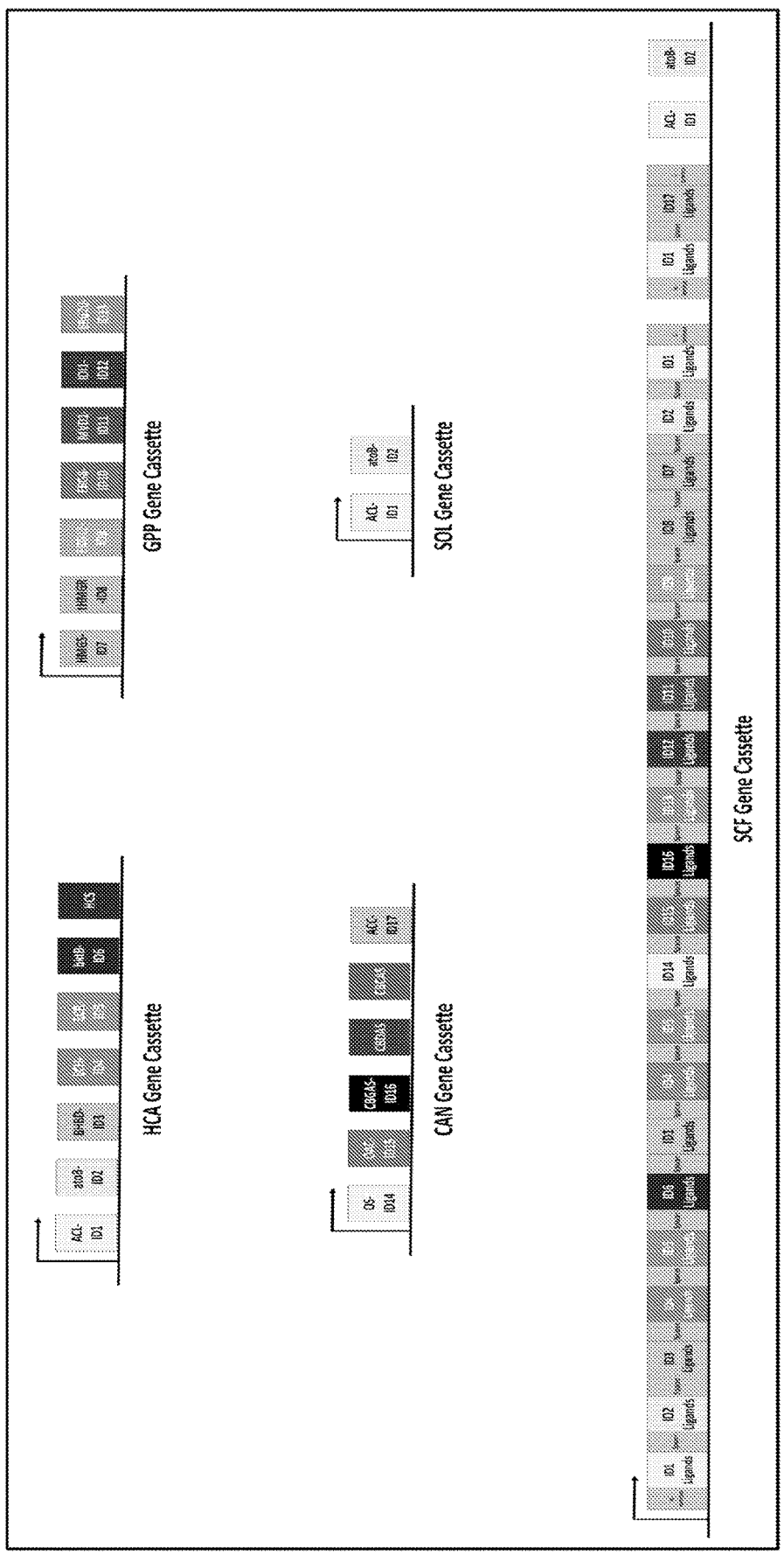
FIG. 2B is a schematic of gene cassettes used in Examples 2-4 for biosynthesizing cannabinoids in yeast.

This document provides recombinant host cells that can be used to produce one or more cannabinoids as described herein. For example, an individual host cell can contain exogenous nucleic acid such that the scaffold polypeptide and each of the enzymes to be immobilized on the scaffold are expressed. It is important to note that such host cells can contain any number and/or combination of exogenous nucleic acid molecules. For example, a particular host cell can contain an exogenous nucleic acid encoding the scaffold, and additional exogenous nucleic acids encoding the enzymes of the malonyl-CoA pathway, enzymes of the hexanoyl-CoA pathway or encoding a HCS, and enzymes of the mevalonate or MEP pathway. A single exogenous nucleic acid can encode one enzyme or more than one enzyme (e.g., one or more copies of from one to ten (or more) enzymes, from one to eight, from one to seven, from one to six, from one to five, from one to four, or from two to three enzymes). Thus, the number of different exogenous nucleic acids needed to produce the engineered enzymes to be localized on the scaffold will depend on the design of the scaffold and/or the particular embodiment. FIG. 2A and FIG. 2B each provide a non-limiting schematic of suitable gene cassettes for expressing the scaffolds and enzymes. FIG. 12C provides the nucleic acid sequence encoding a scaffold polypeptide containing the peptide ligands corresponding to IDs 1-16 as shown in Table 2 and a triplicate MYC tag. See also FIG. 14D for the codon-optimized nucleic acid sequence encoding the scaffold polypeptide of FIG. 13D. FIG. 12D provides the nucleic acid sequence encoding a scaffold polypeptide that contains the peptide ligands corresponding to IDs 1 and 17, and a triplicate FLAG tag. See also FIG. 14D.

In some embodiments, multiple nucleic acids encoding polypeptides (e.g., the nucleic acids of a gene cassette such as in FIG. 2A or FIG. 2B) can be linked together using a nucleic acid sequence encoding a self-cleaving peptide. During translation of the transcripts, the growing polypeptide can be cleaved at the 2A peptide with translation continuing through to the next polypeptide. When designing a vector to express the polypeptides as a polycistronic unit, the nucleic acid encoding the polypeptides and the self-cleaving peptide (e.g., a 2A peptide) can be designed such that they are in translational frame with each other. Examples of 2A peptides that can be used as described herein include, without limitation, a 2A peptide of foot-and-mouth disease virus (FMDV), a 2A peptide of equine rhinitis A virus (ERAVO), a 2A peptide of Thosea asigna virus (TaV), or a 2A peptide of porcine teschovirus-1 (PTV-1) or porcine teschovirus-2 (PTV-2). The 2A peptides from PTV-1 and PTV-2 are referred to as P2A peptides. See, e.g., SEQ ID NO:212 for a codon-optimized nucleotide sequence (for *S. cerevisiae*) encoding a P2A peptide.

Further, the cells described herein can contain a single copy or multiple copies (e.g., about 5, 10, 20, 35, 50, 75, 100 or 150 copies), of a particular exogenous nucleic acid molecule. Again, the cells described herein can contain more than one particular exogenous nucleic acid molecule and/or copies thereof. For example, a particular cell can contain about 50 copies of exogenous nucleic acid molecule X as well as about 75 copies of exogenous nucleic acid molecule Y.

Any method can be used to introduce an exogenous nucleic acid molecule into a host cell. In fact, many methods for introducing nucleic acid into host cells such as bacteria and yeast are well known to those skilled in the art. For example, heat shock, lipofection, electroporation, nucleofection, conjugation, fusion of protoplasts, and biolistic delivery are common methods for introducing nucleic acid into bacteria and yeast cells. See, e.g., Ito et al., *J. Bacteriol.* 153:163-168 (1983); Durrens et al., *Curr Genet.* 18:7-12 (1990); and Becker and Guarente, *Methods in Enzymology* 194:182-187 (1991).

An exogenous nucleic acid molecule contained within a particular host cell can be maintained within that host cell in any form. For example, exogenous nucleic acid molecules can be integrated into the genome of the microorganism or maintained in an episomal state. In other words, a microorganism can be a stable or transient transformant. Again, a microorganism described herein can contain a single copy, or multiple copies (e.g., about 5, 10, 20, 35, 50, 75, 100 or 150 copies), of a particular exogenous nucleic acid molecule as described herein.

Suitable nucleic acid constructs for expressing the engineered enzymes and scaffolds include, for example, CRISPR plasmids, baculovirus vectors, bacteriophage vectors, plasmids, phagemids, cosmids, fosmids, bacterial artificial chromosomes, viral vectors (for example, viral vectors based on vaccinia virus, poliovirus, adenovirus, adeno-associated virus, SV40, herpes simplex virus, and the like), P1-based artificial chromosomes, yeast plasmids, yeast artificial chromosomes, and other vectors. Typically such constructs include a regulatory element that promotes the expression of a nucleic acid sequence that encodes a polypeptide. Typically, regulatory elements are DNA sequences that regulate the expression of other DNA sequences at the level of transcription. Thus, regulatory elements include, without limitation, promoters, enhancers, and the like. Any type of promoter can be used to express an amino acid sequence from an exogenous nucleic acid molecule. Examples of promoters include, without limitation, constitutive promoters, tissue-specific promoters, and inducible or repressible promoters that are responsive or unresponsive to a particular stimulus (e.g., light, oxygen, chemical concentration, sound, and the like).

In some embodiments, endogenous yeast promoters with varying constitutive activity levels can be used to express the engineered enzymes and/or scaffolds. To maintain an excess of enzymes relative to scaffold molecules, the scaffolds can be expressed under control of the weakest promoter. For example, one or more of the following yeast promoters can be used: the promoter from the gene encoding transcriptional elongation factor EF-1α (pTEF1), the promoter from the gene encoding phosphoglycerate kinase (PGK 1), the promoter from the gene encoding triose phosphate isomerase (pTPI1), the promoter from the gene encoding a hexose transporter (pHXT7), HXT7, the promoter from the gene encoding pyruvate kinase 1 (pPYK1), the promoter from the gene encoding alcohol dehydrogenase 1 (pADH1), or the promoter from the gene encoding triphosphate dehydrogenase (pTDH3). For example, in the embodiment shown in FIG. 2A, the pTPI1 promoter can be used to express enzymes of the upper hexanoyl-CoA (HCA), enzymes of the lower HCA pathway, enzymes of the upper mevalonate (MVA) pathway, enzymes of the lower MVA pathway, and enzymes of the lower cannabinoid (CB) pathway, while the pTEF1 promoter can be used to express enzymes of the upper CB pathway, the atoB enzyme, and the enzymes of the malonyl-CoA pathway, and the pADH1 promoter can be used to express the scaffold. Of these promoters, the pADH1 promoter has the weakest activity (+ in FIG. 2A), the pTEF1 promoter has the strongest activity (+++ in FIG. 2A), and the activity of the pTPI1 promoter is between the other two (++ in FIG. 2A). In some embodiments, the Gal 1-10 promoter (e.g., from *S. cerevisiae*) can be used. See, e.g., FIG. 17.

A nucleic acid construct also can include a selectable marker, e.g., for an antibiotic such as neomycin resistance, ampicillin resistance, tetracycline resistance, chloramphenicol resistance, or kanamycin resistance). In some embodiments, a nutritional marker gene that confers prototrophy for an essential nutrient such as tryptophan (TRP1), uracil (URA3), histidine (HIS3), leucine (LEU2), lysine (LYS2), or methionine can be included on a nucleic acid construct. See, e.g., FIG. 17. As shown in Example 3, four different auxotrophic markers were used to sequentially select for transformed cells containing the desired combinations of nucleic acids encoding the enzymes and scaffold. For example, yeast cells transformed with a vector containing a TRP gene and the nucleic acids encoding enzymes of the hexanoyl-CoA pathway were grown in tryptophan deficient media. The transformed cells that grew in the tryptophan deficient media were selected and further transformed with a vector containing a LEU gene and nucleic acid encoding enzymes of the mevalonate pathway. The resulting transformed cells were grown on media lacking tryptophan and leucine, and the cells that grew in the media lacking tryptophan and leucine were transformed with a vector containing a HIS gene and nucleic acids encoding enzymes of the upper cannabinoid pathway. The resulting transformed cells were grown on media lacking tryptophan, leucine, and histidine, and the cells that grew in the media lacking tryptophan, leucine, and histidine were transformed with a vector containing a URA3 gene and a nucleic acid encoding a scaffold. The resulting transformed cells were grown on media lacking tryptophan, leucine, histidine, and uracil. Cells that grew in media lacking tryptophan, leucine, histidine, and uracil contained the desired combination of enzymes and scaffold as shown in FIG. 1B.

In some embodiments, the encoded enzymes (e.g., one or more enzymes from the cannabinoid biosynthesis pathway, mevalonate pathway, MEP pathway, hexanoyl-CoA pathway, or a hexanoyl-CoA synthetase) and/or the scaffold can include a targeting sequence that can be used to direct the enzymes or scaffold to one of several different intracellular compartments, including, for example, the endoplasmic reticulum (ER), mitochondria, plastids (such as chloroplasts), the vacuole, the Golgi apparatus, or protein storage vesicles (PSV). For example, a mitochondrial or plastidial targeting sequence can be used to facilitate mitochondrial or plastidial compartmentalization of cannabinoid/cannabinoid precursor biosynthesis such that the encoded enzymes and scaffold are expressed in the mitochondria or plastids of the host cell.

Figure 11:
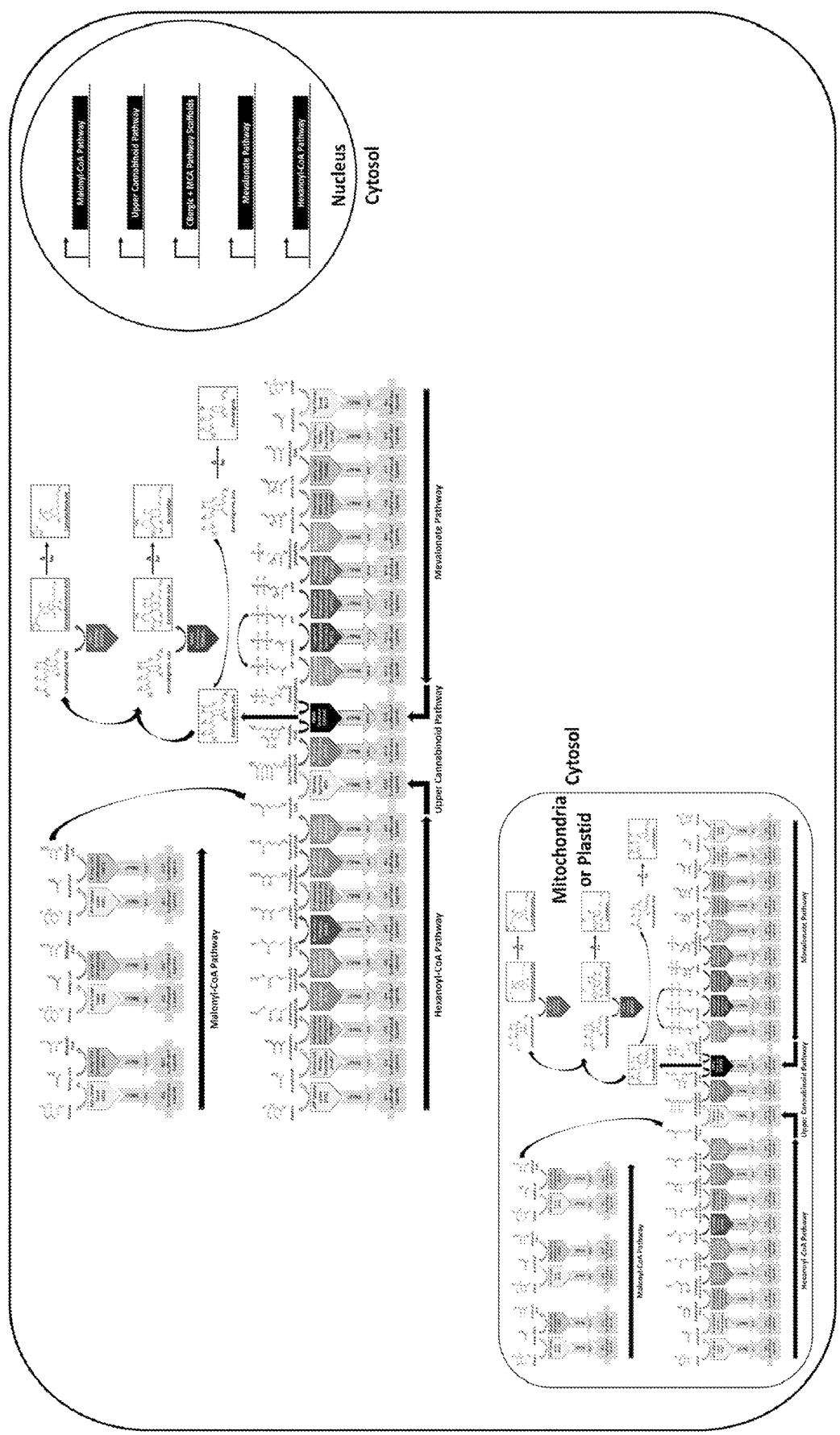
FIG. 11 is a schematic of one representative embodiment of a multi-enzymatic cannabinoidergic scaffold within dual compartments of a cell, the cytosol and mitochondria/plastid.

In some embodiments, cannabinoid/cannabinoid precursor biosynthesis can be performed in two compartments by co-expressing one or more engineered enzymes and a scaffold in both the cytosolic compartment and either the plastids or mitochondria of the host cell. See, for example, FIG. 11. It will be appreciated that while FIG. 11 depicts a scaffold containing enzymes of the hexanoyl-CoA pathway, enzymes of the upper cannabinoid pathway, and enzymes of the mevalonate pathway, dual-compartment engineering can be performed with any of the scaffolds and enzymes described herein. For example, dual-compartment engineering can be performed in two compartments by co-expressing a scaffold and enzymes of the hexanoyl-CoA pathway, enzymes of the upper cannabinoid pathway, and enzymes of the MEP pathway in both the cytosolic compartment and either the plastids of mitochondria of the host cell. Dual-compartment engineering also can be achieved by engineering separate haploid yeast strains for cytosolic and mitochondrial/plastidial cannabinoid biosynthesis, and then mating these two haploid strains to produce a diploid lineage that is heterozygous for cytosolic and mitochondrial/plastidial cannabinoid biosynthesis.

In some embodiments, the engineered enzymes and/or scaffolds also contain a tag that can be used for purification of the recombinant protein (e.g., c-myc, FLAG, polyhistidine (e.g., hexahistidine), hemagglutinin (HA), glutathione-S-transferase (GST), or maltose binding protein (MBP)) or as a detectable marker (e.g., luciferase, green fluorescent protein (GFP), or chloramphenicol acetyl transferase (CAT)). For example, in the embodiment shown in FIG. 6C and FIG. 6D, a scaffold can include a myc tag (e.g., (Myc)3 tag) or a FLAG tag (FLAG)3 tag at the C-terminus.

In some embodiments, a host cell can be engineered to increase acetyl-CoA availability for cannabinoid and cannabinoid precursor biosynthesis. For example, the mitochondrial enzyme isocitrate dehydrogenase-1 (IDH1) can be placed under transient micro-RNA-mediated inducible repression. Since mitochondrial IDH1 is primarily responsible for depletion of the cellular citrate pool, micro-RNA-mediated repression of IDH1 can increase the availability and cytosolic shuttling of citrate for production of acetyl-CoA by ATP citrate lyase. The resulting increase in acetyl-CoA bioavailability can further enhance downstream hexanoyl-CoA and geranyl pyrophosphate titers by improving initial substrate availability for the hexanoyl-CoA and mevalonate pathways. The combinatorial metabolic engineering of acetyl-CoA can mitigate issues related to the siphoning of acetyl-CoA away from the endogenous metabolism of the host cells.

In some embodiments, one or more conventional and/or contemporary gene editing techniques can be used to produce recombinant hosts. For example, clustered, regularly interspaced, short palindromic repeat (CRISPR) technology can be used to modify expression of an endogenous nucleic acid. The CRISPR/Cas system includes components of a prokaryotic adaptive immune system that is functionally analogous to eukaryotic RNA interference, using RNA base pairing to direct DNA or RNA cleavage. The Cas9 protein functions as an endonuclease, and CRISPR RNA (crRNA) and trans-activating RNA (tracrRNA) sequences complex with the Cas9 enzyme and direct it to a target DNA sequence (Makarova et al., *Nat Rev Microbiol* 9(6):467-477, 2011). The modification of a single targeting RNA can be sufficient to alter the nucleotide target of a Cas protein. In some cases, crRNA and tracrRNA can be engineered as a single cr/tracrRNA hybrid (also referred to as a "guide RNA" or "gRNA") to direct Cas9 cleavage activity (Jinek et al., *Science*, 337(6096):816-821, 2012). The CRISPR/Cas system can be used in a variety of prokaryotic and eukaryotic organisms (see, e.g., Jiang et al., *Nat Biotechnol*, 31(3):233-239, 2013; Dicarlo et al., *Nucleic Acids Res*, doi:10.1093/nar/gkt135, 2013; Cong et al., *Science*, 339(6121):819-823, 2013; Mali et al., *Science*, 339(6121):823-826, 2013; Cho et al., *Nat Biotechnol*, 31(3):230-232, 2013; and Hwang et al., *Nat Biotechnol*, 31(3):227-229, 2013).

Another gene-editing technique can include a sequence-specific nuclease created by fusing transcription activator-like effectors (TALEs) to, for example, the catalytic domain of the FoId endonuclease. Both native and custom TALE-nuclease ("TALEN") fusions direct DNA double-strand breaks to specific, targeted sites. See, for example, Christian, et al., *Genetics* 186: 757-761 (2010) and U.S. Patent Publication No. 20110145940.

Other suitable gene insertion techniques include the use of retroviral vectors and biolistic particle gene delivery systems (colloquially known as "gene guns").

Methods of identifying and/or selecting host cells that contain exogenous nucleic acid or a modified endogenous nucleic acid are well known to those skilled in the art. Such methods include, without limitation, the introduction and expression of a negative selection marker such as an antibiotic resistance gene, PCR, and nucleic acid hybridization techniques such as Northern and Southern analyses. In some cases, immunohistochemistry and biochemical techniques can be used to determine if a microorganism contains a particular nucleic acid by detecting the expression of the encoded enzymatic polypeptide encoded by that particular nucleic acid molecule. For example, an antibody having specificity for an encoded enzyme can be used to determine whether or not a particular cell contains that encoded enzyme. Further, biochemical techniques can be used to determine if a cell contains a particular nucleic acid molecule encoding an enzymatic polypeptide by detecting an organic product produced as a result of the expression of the enzymatic polypeptide.

This document also provides isolated nucleic acids molecules. The term "isolated" as used herein with reference to nucleic acid refers to a naturally-occurring nucleic acid that is not immediately contiguous with both of the sequences with which it is immediately contiguous (one on the 5' end and one on the 3' end) in the naturally-occurring genome of the organism from which it is derived. For example, an isolated nucleic acid can be, without limitation, a recombinant DNA molecule of any length, provided one of the nucleic acid sequences normally found immediately flanking that recombinant DNA molecule in a naturally-occurring genome is removed or absent. Thus, an isolated nucleic acid includes, without limitation, a recombinant DNA that exists as a separate molecule (e.g., a cDNA or a genomic DNA fragment produced by PCR or restriction endonuclease treatment) independent of other sequences as well as recombinant DNA that is incorporated into a vector, an autonomously replicating plasmid, a virus (e.g., a retrovirus, adenovirus, or herpes virus), or into the genomic DNA of a prokaryote or eukaryote. In addition, an isolated nucleic acid can include a recombinant DNA molecule that is part of a hybrid or fusion nucleic acid sequence.

The term "isolated" as used herein with reference to nucleic acid also includes any non-naturally-occurring nucleic acid since non-naturally-occurring nucleic acid sequences are not found in nature and do not have immediately contiguous sequences in a naturally-occurring genome. For example, non-naturally-occurring nucleic acid such as an engineered nucleic acid is considered to be isolated nucleic acid. Engineered nucleic acid can be made using common molecular cloning or chemical nucleic acid synthesis techniques. Isolated non-naturally-occurring nucleic acid can be independent of other sequences, or incorporated into a vector, an autonomously replicating plasmid, a virus (e.g., a retrovirus, adenovirus, or herpes virus), or the genomic DNA of a prokaryote or eukaryote. In addition, a non-naturally-occurring nucleic acid can include a nucleic acid molecule that is part of a hybrid or fusion nucleic acid sequence.

It will be apparent to those of skill in the art that a nucleic acid existing among hundreds to millions of other nucleic acid molecules within, for example, cDNA or genomic libraries, or gel slices containing a genomic DNA restriction digest is not to be considered an isolated nucleic acid.

In some embodiments, the production of one or more cannabinoids can be performed in vitro using the scaffold and immobilized enzymes described herein, using a lysate (e.g., a buffered cell lysate) from a recombinant host cell as a source of the scaffold and enzymes, using a plurality of lysates from different host cells as the source of the scaffold and enzymes, or using an acellular reaction buffer such as a synthetic reaction buffer. For example, following co-immunoprecipitation of C-terminal Myc/Flag-tagged enzyme-bound scaffolds, scaffold-enzyme complexes can be maintained in a citrate-supplemented and/or glucose-supplemented (or other carbon source-supplemented) reaction buffer which allows in-vitro scaffolded cannabinoid biosynthesis.

Producing Cannabinoids Using a Recombinant Host

Typically, one or more cannabinoids can be produced by providing a recombinant host such as a recombinant microorganism and culturing the microorganism with a culture medium. In general, the culture media and/or culture conditions can be such that the microorganisms grow to an adequate density and produce cannabinoids efficiently. For example, the microorganisms can be subjected to aerobic batch fermentation. In some embodiments, one or more precursors (e.g., citrate, glucose, hexanoic acid, and/or other carbon source and/or malonyl-CoA) are supplemented in the culture medium. In some embodiments, about 30 mg/L to about 10,000 mg/L (e.g., about 100 mg/L to about 5,000 mg/L, about 200 mg/L to about 4,000 mg/L, about 300 mg/L to about 3,000 mg/L, or about 350 mg/L to about 1,000 mg/L) of buffered citrate, pH 6.0 can be added to the culture medium.

For large-scale production processes, any method can be used such as those described elsewhere (Manual of Industrial Microbiology and Biotechnology, $2^{nd}$ Edition, Editors: A. L. Demain and J. E. Davies, ASM Press; and Principles of Fermentation Technology, P. F. Stanbury and A. Whitaker, Pergamon). Briefly, a large vessel (e.g., a 100 gallon, 200 gallon, 500 gallon, or higher volume vessel) containing an appropriate culture medium is inoculated with a particular microorganism. After inoculation, the microorganism is incubated to allow biomass to be produced. Once a desired biomass or cellular confluency is attained, a portion or all of the broth containing the microorganisms can be transferred to a second vessel. This second vessel can be any size. For example, the second vessel can be larger, smaller, or the same size as the first vessel. Typically, the second vessel is larger than the first such that additional culture medium can be added to the broth from the first vessel. In addition, the culture medium within this second vessel can be the same as, or different from, that used in the first vessel. This system can expand to include an array consisting of any number of individual vessels.

Once transferred, the microorganisms can be incubated to allow for the production of one or more cannabinoids. Once produced, any method can be used to isolate cannabinoids. For example, common separation techniques can be used to remove the biomass from the broth, and common isolation procedures (e.g., extraction such as non-polar extraction with hexane followed by ethyl-acetate), high-performance liquid chromatography (e.g., HPLC with a diode array detector (HPLC-DAD)), gas chromatography-flame ionization detection (GC-FID), or ion-exchange procedures) can be used to obtain the cannabinoids from the biomass.

A host cell described herein can produce one or more cannabinoids at a concentration of at least about 10 mg per L (e.g., at least about 15 mg/L 25 mg/L, 50 mg/L, 75 mg/L, 100 mg/L, 150 mg/L, 200 mg/L, 250 mg/L or more). For example, in some embodiments, total cannabinoids (total of CBG CBGA, CBD, CBDA, CBC, and CBCA) can be produced at a concentration of at least about 10 mg/L, 15 mg/L, 20 mg/L, 40 mg/L, 60 mg/L, 80 mg/L, or 100 mg/L or more. For example, in some embodiments, total cannabinoids (total of CBG, CBGA, CBD, CBDA, CBC, and CBCA) can be produced at a concentration from about 10 mg/L to about 500 mg/L (e.g., 20 mg/L to 450 mg/L, 40 mg/L to 380 mg/L, 60 mg/L to 280 mg/L, 60 mg/L to 250 mg/L, 60 mg/L to 150 mg/L, 80 mg/L to 400 mg/L, 80 mg/L to 300 mg/L, 80 mg/L to 250 mg/L, 80 mg/L to 200 mg/L, 80 mg/L to 175 mg/L, 90 mg/L to 400 mg/L, 90 mg/L to 300 mg/L, 90 mg/L to 250 mg/L, or 90 mg/L to 150 mg/L). In some embodiments, one or more individual cannabinoids (e.g., one or more of CBG CBGA, CBD, CBDA, CBC, and CBCA) can be produced at concentrations of at least about 1 mg/L, 2 mg/L, 5 mg/L, 10 mg/L, 15 mg/L, 20 mg/L, 25 mg/L, 30 mg/L, 35 mg/L, 40 mg/L, 45 mg/L, 50 mg/L, 55 mg/L, 60 mg/L, 65 mg/L, 70 mg/L, 75 mg/L, 80 mg/L, 85 mg/L, 90 mg/L, 95 mg/L, 100 mg/L or more. For example, in some embodiments, one or more individual cannabinoids can be produced at a concentration from about 1 mg/L to about 100 mg/L (e.g., 2 to 90 mg/L, 2 to 80 mg/L, 2 to 70 mg/L, 2 to 60 mg/L, 2 to 50 mg/L, 2 to 40 mg/L, 2 to 30 mg/L, 2 to 20 mg/L, 2 to 15 mg/L, 3 to 90 mg/L, 3 to 80 mg/L, 3 to 70 mg/L, 3 to 60 mg/L, 3 to 50 mg/L, 3 to 40 mg/L, 3 to 30 mg/L, 3 to 20 mg/L, 3 to 15 mg/L, 4 to 90 mg/L, 4 to 80 mg/L, 4 to 70 mg/L, 4 to 60 mg/L, 4 to 50 mg/L, 4 to 40 mg/L, 4 to 30 mg/L, 4 to 20 mg/L, or 4 to 15 mg/L).

The invention will be further described in the following examples, which do not limit the scope of the invention described in the claims.

EXAMPLES

Example 1—General Methods

Enzymatic Constructs

Each enzyme construct is designed to include an interaction domain (ID) which is comprised of two tandem N-terminal or C-terminal ligand-binding motifs which are separated from the given enzyme and from one another by an amino acid sequence containing flexible GS-rich linkers flanking a rigid α-helical spacer sequence. The motifs comprising the ID of each enzyme specifically bind tandem peptide ligands which form ID-binding sites at discrete locations along a synthetic intracellular polypeptide scaffold. Expression of each enzyme is controlled by a constitutive or inducible promoter. The nucleic acid encoding the enzyme can be codon optimized, e.g., for expression in yeast.

Scaffolding Constructs

ID-binding sites containing tandem peptide ligands that are specific for the tandem scaffold-binding motifs, which comprise the ID of each enzyme, are inserted at discrete positions along an intracellular polypeptide scaffold.

The tandem ligands which comprise each scaffolded ID-binding site are separated from one another by a 36 amino acid residue sequence containing flexible GS-rich linkers flanking a rigid α-helical spacer sequence, while the scaffolded ID-binding sites themselves are separated from one another by a 50 amino acid residue sequence (or any other number of amino acid residues) containing flexible GS-rich linkers flanking a rigid α-helical spacer sequence. Specifically, the scaffold binding sites for each enzyme in the hexanoyl-CoA pathway are positioned (in order of catalysis) proximally to ATP citrate lyase and acetyl-CoA acetyltransferase at the N-terminus of the primary scaffold. Scaffold binding sites for each enzyme in the upper cannabinoid pathway are positioned proximally to (immediately downstream of) the binding sites for the hexanoyl-CoA pathway enzymes. The scaffold binding sites for each enzyme in the mevalonate (or MEP) pathway are positioned (in order of catalysis) proximally to ATP citrate lyase and acetyl-CoA acetyltransferase at the C-terminus of the primary scaffold. The enzyme catalyzing the rate-limiting/committed step in cannabinoid biosynthesis (CBGA synthase, the final enzymatic step in the upper cannabinoid pathway) is located at the intersection of the converging cannabinoid precursor pathways near the scaffold midpoint.

Assessment of Cannabinoidergic Potential by Transient Transfection

Competent yeast and/or green algae cells are transiently transfected with plasmids encoding various permutations of the scaffold and enzymes. To establish baseline cannabinoidergic capacity, cells first undergo transient transfection with the enzymes required for cannabinoid biosynthesis (but not the scaffolds), and biosynthesized cannabinoids are extracted, isolated, and quantified as described below (see "Cannabinoid Extraction, Isolation, and Analytical Characterization"). To measure the improvement in cannabinoidergic capacity conferred by multi-enzymatic scaffolding, a subset of the aforementioned cells is co-transfected with plasmids encoding one or more of the multi-enzymatic scaffolds described herein, and biosynthesized cannabinoids are extracted, isolated, and quantified. The presence of the plasmid DNA is confirmed by PCR, functional gene expression is confirmed by qRT-PCR, protein/polypeptide production is confirmed by Western blotting, and scaffolding of each enzyme is confirmed by co-immunoprecipitation of C-terminal myc/flag-tagged scaffolds followed by Western blot analysis of each co-immunoprecipitated enzyme.

Engineering of Stable Cannabinoidergic Cell Lines

The constructs can be integrated into the genome of host cells such yeast, green algae, or other suitable hosts via stable transfection. Gene integration is confirmed by so PCR, functional gene expression is confirmed by qRT-PCR, and protein/polypeptide production is confirmed by Western blotting. Gene expression/protein synthesis is confirmed by comparing both qRT-PCR and Western blot results among samples with and without genetic engineering. To assess the improvement in cannabinoidergic capacity conferred by multi-enzymatic scaffolding for stably engineered cannabinoidergic cell lines, cannabinoid biosynthesis will be compared among cells that are stimulated for enzyme but not scaffold expression and cells that are stimulated for enzyme and scaffold expression.

Validation of Multi-Enzymatic Scaffolding

To verify successful multi-enzymatic scaffolding in both transiently transfected and stably engineered cells, a myc-tag (or other immunoprecipitable tag) is inserted at the N-terminal or C-terminal of the polypeptide scaffold(s). Scaffolded enzymes are selectively co-immunoprecipitated by affinity chromatography using anti-myc affinity beads. Western blots are performed to detect and quantify each co-immunoprecipitated enzyme.

Aerobic Fed-Batch Fermentation

Stably engineered cannabinoidergic yeast, green algae, or other host cells are grown in bioreactors (or any other vessel) via aerobic batch fermentation (or any other culture technique).

Cannabinoid Extraction, Isolation and Analytical Characterization

Following sufficient elicitation of cannabinoid biosynthesis, engineered yeast/green algae cells are pelleted by centrifugation and washed with TBS. The supernatant (liquid culture media) is decanted and collected. Following washing with TBS, pelleted cells are resuspended in NaOH adjusted ethanol and lysed by iterative freeze-thawing and ultrasonication. Biosynthesized cannabinoid fermentates are then harvested from both lysates and supernatants via triplicate nonpolar extractions using hexane followed by ethyl-acetate. The resulting organic fractions are pooled and roto-evaporated. High-performance liquid chromatography with a diode array detector (HPLC-DAD) or gas chromatography-flame ionization detection (GC-FID) is then applied for quantitative and qualitative measurement of biosynthesized cannabinoids.

In the following examples, each 48-hour culture was lysed/homogenized by ultrasonication. Ultrasonicated samples were then subjected to triplicate liquid-liquid extractions with ethyl acetate (one volumetric equivalent of ethyl acetate per extraction). Following separation, the ethyl acetate fractions collected from each sample were pooled, and the pooled samples were centrifugally filtered. Ethyl acetate was then removed from each sample in a vacuum oven, and the residual samples were resuspended in 10 mL methanol for analytical characterization. Analytical characterization of all samples was conducted by a licensed, independent, third-party analytical testing facility (Precision Plant Molecules, Denver, Colo.). HPLC-DAD was utilized for quantitative and qualitative measurement of each parent and derivative cannabinoid as well as the cannabinoid precursor OVA.

Example 2—Synthetic Gene Cassette Assembly/Synthesis, Plasmid Preparation, and Polycistronic Vector Construction Five synthetic gene cassettes (entitled HCA, GPP, CAN, SCF, and SOL) were constructed for biosynthesizing cannabinoids in heterologous cells or acellular reaction buffers. See, FIG. 2B. The cassettes collectively encode all scaffold-binding engineered enzymes and the polypeptide scaffolds to which the engineered enzymes can bind.

The HCA gene cassette encoded scaffold-binding engineered enzymes for scaffolded hexanoyl-CoA biosynthesis, namely ACL, atoB, BHBD, ECH, ECR, and bktB, and encoded a soluble HCS for additional hexanoyl-CoA production from hexanoate-supplemented culture media or acellular reaction buffer. See, FIG. 13A. The GPP gene cassette encoded scaffold-binding engineered enzymes for scaffolded geranyl pyrophosphate (GPP) biosynthesis, namely HMGS, tHMGR, ERG12, ERG8, MVD1, IDI1, and ERG20$^{WW}$. See, FIG. 13B. The CAN gene cassette encoded scaffold-binding engineered enzymes for scaffolded OAC, malonyl-CoA, and CBGA biosynthesis, namely OS and OAC, ACC, and CBGAS, respectively, as well all enzymes for soluble (non-scaffolded) CBDA and CBCA biosynthesis, namely CBDAS and CBCAS, respectively. See, FIG. 13C. The SCF gene cassette encoded the polypeptide scaffolds for bidirectional scaffolded cannabinoid biosynthesis and scaffolded malonyl-CoA biosynthesis, namely the cannabinoidergic metabolon scaffold (CBSCF) and the malonyl-CoA metabolon scaffold (MCASCF), respectively, as well as additional copies of both ACL and atoB to enhance acetyl-CoA biosynthesis from supplemental and/or endogenous citrate and acetoacetyl-CoA biosynthesis from acetyl-CoA, respectively. See, FIG. 13D. The SOL gene cassette lacked the polypeptide scaffolds for bidirectional scaffolded cannabinoid biosynthesis and scaffolded malonyl-CoA biosynthesis (i.e., it was used for soluble cannabinoid biosynthesis) but, analogous to the SCF gene cassette, encoded additional copies of ACL and atoB to enhance acetyl-CoA biosynthesis from supplemental and/or endogenous citrate and acetoacetyl-CoA biosynthesis from acetyl-CoA. See, FIG. 13A for the amino acids sequences of the ACL and atoB engineered enzymes.

Gene cassettes were assembled/synthesized using self-cleaving 2A peptides (P2As) to link multiple codon-optimized (for S. cerevisiae) gene sequences assigned to each cassette. To improve P2A cleavage, a GSG linker (comprised of a single serine residue flanked by single glycine residues) was inserted at the interface between each constituent gene sequence and the P2A linker sequence to which it was fused (of the format: gene cassette sequence 1-SG-P2A linker-gene cassette sequence 2-GSG-P2A linker-gene cassette sequence 3-GSG-P2A linker-) and so forth. See, FIGS. 14A-14D for codon-optimized nucleic acid sequences encoding the engineered enzymes and scaffolds. Following assembly, each synthetic gene cassette was inserted into a pCCI-Brick plasmid, resulting in plasmids entitled pHCA, pGPP, pCAN, pSCF, and pSOL as described in Table 3. See, FIGS. 15A-15E for the complete gene cassette inserted into the plasmids. Each of these plasmids then were used to amplify each synthetic gene cassette via standard plasmid prep. Plasmid DNA encoding each complete synthetic gene cassette was cloned into the SpeI/XhoI cloning site of polycistronic yeast auxotrophic selection vectors, resulting in vectors entitled vHCA, vGPP, vCAN, vSCF, and vSOL as described in Table 3, to allow iterative antibiotic/auxotrophic selection of only those cells that were transformants of one or more such polycistronic vector(s).

TABLE 3

| HCA Gene Cassette | | | | |
|---|---|---|---|---|
| Gene ID | Cassette Position | pCCI-Brick #1 ID | Yeast Vector | Yeast Vector ID |
| ACL | 1 | pHCA | pESC-TRP | vHCA |
| atoB | 2 | | | |
| BHBD | 3 | | | |
| ECH | 4 | | | |
| ECR | 5 | | | |
| bktB | 6 | | | |
| HCS | 7 | | | |
| MVA Gene Cassette | | | | |
| Gene ID | Cassette Position | pCCI-Brick #2 ID | Yeast Vector | Yeast Vector ID |
| HMGS | 1 | pGPP | pESC-LEU | vGPP |
| tHMGR | 2 | | | |
| ERG12 | 3 | | | |
| ERG8 | 4 | | | |
| MVD1 | 5 | | | |
| IDI1 | 6 | | | |
| EKG20$^{WW}$ | 7 | | | |
| CAN Gene Cassette | | | | |
| Gene ID | Cassette Position | pCCI-Brick #3 ID | Yeast Vector | Yeast Vector ID |
| OS | 1 | pCAN | pESC-HIS | vCAN |
| OAC | 2 | | | |
| CBGAS | 3 | | | |
| CBDAS | 4 | | | |
| CBCAS | 5 | | | |
| ACC | 6 | | | |

TABLE 3-continued

SCFLD Gene Cassette

| Gene ID | Cassette pCCI-Brick #4 Position ID | Yeast Vector | Yeast Vector ID |
|---|---|---|---|
| CBSCF | 1 | pSCF | pESC-URA #1 vSCF |
| MCASCF | 2 | | |
| ACL | 3 | | |
| atoB | 4 | | |

NSCFLD Gene Cassette

| Gene ID | Cassette pCCI-Brick #5 Position ID | Yeast Vector | Yeast Vector ID |
|---|---|---|---|
| ACL | 1 | pSOL | pESC-URA #2 vSOL |
| atoB | 2 | | |

The genes assigned to each synthetic gene cassette as well as the plasmids and vectors into which each synthetic gene cassette was inserted are listed in Table 3, the amino acid sequences encoded by each synthetic gene cassette are provided in FIGS. 13A-13D, the codon-optimized nucleotide sequence fragments comprising each synthetic gene cassette are detailed in FIGS. 14A-14D, the complete nucleotide sequences of each fully-assembled synthetic gene cassette (the complete insert sequences for each plasmid and expression vector) are provided in FIGS. 15A-15E, a general map of pCCI-Brick plasmids is shown in FIG. 16, and a general map of a polycistronic yeast auxotrophic selection vector is shown in FIG. 17.

Example 3—Engineering of Cannabinoidergic Cells

To engineer a novel heterologous pathway for the biosynthesis of cannabinoids from citrate, and to evaluate the impacts of bidirectional multi-enzymatic scaffolding thereon, competent *S. cerevisiae* cells were sequentially/iteratively transformed with, and auxotrophically selected for, expression of vHCA, vGPP, vCAN, and either vSCF (for scaffolded cannabinoid biosynthesis) or vSOL (for non-scaffolded/soluble cannabinoid biosynthesis) constructs.

All vector transformation and auxotrophic selection procedures were conducted as follows. An aliquot of an overnight *S. cerevisiae* culture was inoculated into 100 mL YPD media (10 g/L yeast nitrogen base, 20 g/L peptone, and 20 g/L D-(+)-glucose) to $OD_{600nm}$=0.3 (stationary phase) and grown to $OD_{600nm}$=1.6 in an orbital shaker at 30° C. and 225 RPM. Cells then were harvested by centrifugation at 3000×g for 3 minutes followed by aspiration of media. The harvested cell pellet was next washed 2× with 50 mL chilled nuclease-free water and 1× with 50 mL chilled electroporation buffer (1M sorbitol/1 mM $CaCl_2$)). Washed cells were conditioned by incubation for 30 minutes in 20 mL 0.1M LiAc/10 mM DTT in an orbital shaker at 30° C. and 225 RPM, harvested, washed 1× with 50 mL electroporation buffer, harvested, and resuspended in 100 μL electroporation buffer. The resuspended cells were transformed with a quantity of vector containing 3 μg of the target DNA insert (calculated using the vector-insert ratio for each vector) by electroporation at 2.5 kV and 25 μF. To the electroporated cell suspension was then added 8 mL of YPD media containing 1M sorbitol, and the resulting suspension was incubated for one hour in an orbital shaker at 30° C. and 225 RPM. To isolate target transformants by auxotrophic selection, cells were harvested, resuspended in the appropriate yeast nitrogen base (YNB) dropout (selection) media as subsequently described for each iterative transformation step, transferred to a baffled culture flask, and incubated overnight in an orbital shaker at 30° C. and 225 RPM. The transformation and selection protocols were utilized sequentially for each assigned vector.

Applying the aforementioned approach, an initial culture of electrocompetent *S. cerevisiae* cells was first transformed with vHCA, which encodes scaffold-binding engineered enzymes required for biosynthesis of HCA from citrate. Cells transformed with vHCA (designated yHCA) were selected for by resuspension and incubation in tryptophan-deficient YNB media. Selected yHCA cells (i.e., cells that grew in tryptophan-deficient YNB media) were next transformed with vGPP, which encodes scaffold-binding engineered enzymes required for biosynthesis of GPP from citrate. Cells co-transformed with vHCA and vGPP (designated yHCAGPP) were selected for by resuspension and incubation in tryptophan- and leucine-deficient YNB media. Selected yHCAGPP cells (i.e., cells that grew in tryptophan- and leucine-deficient YNB media) were then transformed with vCAN, which encodes scaffold-binding engineered enzymes required for biosynthesis of malonyl-CoA from citrate, olivetol from HCA and malonyl-CoA, OVA (olivetoic acid) from olivetol, and CBGA from OVA and GPP as well as soluble enzymes required for biosynthesis of CBDA and CBCA from CBGA). Cells co-transformed with vHCA, vGPP, and vCAN (designated $yCB_{Parent}$) were selected for by resuspension and incubation in tryptophan-, leucine-, and histidine-deficient YNB media.

The $yCB_{Parent}$ culture containing cells that grew in tryptophan-, leucine-, and histidine-deficient YNB media then was split into two separate cultures. The first of the split $yCB_{Parent}$ cultures was transformed with vSCF, which encodes CBSCF (cannabinoidergic metabolon scaffold) and MCASCF (malonyl-CoA metabolon scaffold) as well as additional copies of ACL and atoB. Cells co-transformed with vHCA, vGPP, vCAN, and vSCF (designated $yCB_{SCF}$) were selected for by resuspension and incubation in tryptophan-, leucine-, histidine-, and uracil-deficient YNB media. The second of the split $yCB_{Parent}$ cultures was transformed with vSOL, which encodes additional copies of ACL and atoB but lacks both CBSCF and MCASCF. Cells co-transformed with vHCA, vGPP, vCAN, and vSOL (designated $yCB_{SOL}$) were also selected for by resuspension and incubation in tryptophan-, leucine-, histidine-, and uracil-deficient YNB media.

To quantify the improvement in cannabinoidergic capacity conferred by multi-enzymatic scaffolding, cannabinoid titers were compared between triplicate $yCB_{SOL}$ and $yCB_{SCF}$ cultures grown in 100 mL YPD media for 48 hours at 30° C. and 400 RPM in an incubator-shaker. To compare the proliferation rates of $yCB_{SOL}$ and $yCB_{SCF}$, each culture was initially diluted to $OD_{600nm}$=0.3, and $OD_{600nm}$ measurements were recorded in 12-hour intervals thereafter. Proliferation curves are depicted in FIG. 18. The extra sum-of-squares F-test indicated that the proliferation curves of $yCB_{SCF}$ and $yCB_{SOL}$ cultures did not significantly differ for any parameter over the 48-hour incubation period, indicating that scaffolding does not impact cellular proliferation.

Total cannabinoid titers, parent (carboxylated) cannabinoid (CBGA, CBDA, and CBCA) titers, derivative (decarboxylated) cannabinoid (CBG, CBD, and CBC) titers, and cannabinoid precursor (OVA) titers were measured. As shown in FIG. 19, mixed ANOVA detected main effects of strain ($F_{1,4}$=943.8; $p<0.0001$) and analyte (cannabinoid and cannabinoid precursor) titers ($F_{10,40}$=216.4; $p<0.0001$) and a significant strain x analyte interaction ($F_{10,40}$=131.4; $p<0.0001$). Relative to $yCB_{SOL}$ cultures, $yCB_{SCF}$ cultures exhibited increased total cannabinoid (p<0.0001), OVA precursor (p<0.0001), CBG(A) (p<0.0001), CBD(A) (p<0.0001), CBC(A) (p<0.0001), CBGA (p<0.0001), CBDA (p<0.0001), CBCA (p<0.0001), CBG (p<0.0001), CBD (p<0.01), and CBC (p<0.001) titers.

Example 4—Impacts of Citrate and Hexanoate Supplementation on Scaffolded and Soluble Cannabinoid Biosynthesis To evaluate the impacts of culture media supplementation with citrate and hexanoate precursors, cannabinoid titers were compared between triplicate $yCB_{SOL}$ and $yCB_{SCF}$ cultures grown in 100 mL YPD media containing 300 mg/L of either buffered citrate (pH 6.0) or hexanoate for 48 hours at 30° C. and 400 RPM in an orbital shaker. All cultures were initially diluted to $OD_{600nm}0=0.3$. Cannabinoid titers for cultures grown in YPD media, citrate-supplemented YPD media, and hexanoate-supplemented YPD media were assessed and analyzed by ANOVA. As shown in FIG. 20, mixed ANOVA detected main effects of strain ($F_{1,4}$=457.5; p<0.0001) and culture media supplementation ($F_{2,8}$=312.5; p<0.0001) and a significant strain x culture media supplementation interaction ($F_{2,8}$=289.6; p<0.0001). Compared to basal media cultures, yCBSCF but not yCBSOL cultures exhibited increased total cannabinoid titers when cultured in media supplemented with 300 mg/L citrate (p<0.0001). Neither yCBSCF nor yCBSOL cultures differed in total cannabinoid titers relative to basal media when cultured in media supplemented with 300 mg/L hexanoate. For all measures, n=3 biological replicates for yCBSCF and yCBSOL cultures. Moreover, relative to yCBSOL cultures, yCBSCF cultures exhibited increased total cannabinoid titers when cultured in basal media (p<0.0001, data also reported in FIG. 19) as well as media supplemented with 300 mg/L citrate (p<0.0001) and hexanoate (p<0.0001).

To delineate concentration-response relationships for the supplementation of culture media with citrate, cannabinoid titers were compared between triplicate $yCB_{SOL}$ and $yCB_{SCF}$ cultures grown in 100 mL YPD media containing 0, 10, 30, 100, 300, 1000, 3000, and 10000 mg/L buffered citrate (pH 6.0) for 48 hours at 30° C. and 400 RPM in an orbital shaker. All cultures were initially diluted to $OD_{600m}$=0.3. Following quantification, asymmetric sigmoidal (five-parameter) logistic regressions were computed to fit concentration-response curves, from which were derived estimates of the maximal cannabinoid titer ($CB_{Max}$) and citrate $EC_{50}$ for cannabinoid biosynthesis in $yCB_{SOL}$ and $yCB_{SCF}$ cultures. Concentration-response curves, $CB_{Max}$ estimates, and citrate EC50 estimates are depicted in FIG. 21. Mixed ANOVA detected main effects of strain ($F_{1,8}$=69.9; p<0.0001) and parameter ($F_{1,8}$=66.7; p<0.0001) and a significant strain x parameter interaction ($F_{1,8}$=5.3; p<0.05) for concentration-response parameter estimates (CBMax and citrate EC50). Compared to yCBSOL cultures, yCBSCF cultures exhibited markedly increased CBMax (p<0.0001) and citrate EC50 (p<0.001) estimates.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (212 sequences)

SEQ ID NO: 1 - protein, 11 aa, Artificial Sequence
  peptide binding motif
PPPALPPKRRR

SEQ ID NO: 2 - protein, 32 aa, Artificial Sequence
  peptide binding motif
LVGALMHVMQKRSRAIHSSDEGEDQAGDEDED

SEQ ID NO: 3 - protein, 43 aa, Artificial Sequence
  peptide binding motif
ITIRAAFLEKENTALRTEIAELEKEVGRCENIVSKYETRYGPL

SEQ ID NO: 4 - protein, 43 aa, Artificial Sequence
  peptide binding motif
LEIRAAFLEKENTALRTRAAELRKRVGRCRNIVSKYETRYGPL

SEQ ID NO: 5 - protein, 70 aa, Artificial Sequence
  peptide binding motif
SYYHHHHHHLESTSLYKKAGSGSNLVAQLENEVASLENENETLKKKNLHKKDLIAYLEKEIANLRKKIEE

SEQ ID NO: 6 - protein, 73 aa, Artificial Sequence
  peptide binding motif
SYYHHHHHHLESTSLYKKAGSGSARNAYLRKKIARLKKDNLQLERDEQNLEKIIANLRDEIARLENEVASHEQ

SEQ ID NO: 7 - protein, 65 aa, Artificial Sequence
  peptide binding motif
SYYHHHHHHLESTSLYKKAGSGSNEVTTLENDAAFIENENAYLEKEIARLRKEKAALRNRLAHKK

SEQ ID NO: 8 - protein, 77 aa, Artificial Sequence
  peptide binding motif
SYYHHHHHHLESTSLYKKAGSGSQKVAELKNRVAVKLNRNEQLKNKVEELKNRNAYLKNELATLENEVARLENDVAE

SEQ ID NO: 9 - protein, 64 aa, Artificial Sequence
  peptide binding motif
ENLYFQGENLYFQGDSSESCWNCGRKASETCSGCNTARYCGSFCQHKDWEKHHHICGQTLQAQQ

SEQ ID NO: 10 - protein, 145 aa, Artificial Sequence
  peptide binding motif
MAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRP

SEQ ID NO: 11 - protein, 88 aa, Artificial Sequence
  peptide binding motif
GPLGSPLTASMLASAPPQEQKQMLGERLFPLIQAMHPTLAGKITGMLLEIDNSELLHMLESPESLRSKVDEAVAVLQAHQAKEAAQKA

SEQ ID NO: 12 - protein, 107 aa, Artificial Sequence
  peptide binding motif
NTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVV

SEQ ID NO: 13 - protein, 65 aa, Artificial Sequence
  peptide binding motif
SYYHHHHHHLESTSLYKKAGSGSNLLATLRSTAAVLENENHVLEKEKEKLRKEKEQLLNKLEAYK

SEQ ID NO: 14 - protein, 73 aa, Artificial Sequence
  peptide binding motif
SYYHHHHHHLESTSLYKKAGSGSKRIAYLRKKIAALKKDNANLEKDIANLENEIERLIKEIKTLENEVASHEQ

SEQ ID NO: 15 - protein, 62 aa, Artificial Sequence [sequence omitted]

SEQ ID NO: 16 - protein, 85 aa, Artificial Sequence
  peptide binding motif
ESDSVEFNNAISYVNKIKTRFLDHPEIYRSFLEILHTYQKEQLHTKGRPFRGMSEEEVFTEVANLFRGQEDLLSEFGQFLPEAKR

SEQ ID NO: 17 - protein, 36 aa, Artificial Sequence
  peptide binding motif
LGPLPPGWEVRSTVSGRIYFVDHNNRTTQFTDPRLH

SEQ ID NO: 18 - protein, 37 aa, Artificial Sequence
  peptide binding motif
GAMGPLPPGWEKRTDSNGRVYFVNHNTRITQWEDPRS

SEQ ID NO: 19 - protein, 101 aa, Artificial Sequence
  peptide binding motif
SYYHHHHHHLESTSLYKKAGSEFFRRERNKMAAAKCRNRRRELTDTLQAETDQLEDEKSALQTEIANLLKEKEKLEFILAAHRPACKIPDDLGFPEEMSLE

SEQ ID NO: 20 - protein, 59 aa, Artificial Sequence
  peptide binding motif
SYYHHHHHHLESTSLYKKAGSGSQKVESLKQKIEELKQRKAQLKNDIANLEKEIAYAET

SEQ ID NO: 21 - protein, 147 aa, Artificial Sequence
  peptide binding motif
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKS

SEQ ID NO: 22 - protein, 171 aa, Artificial Sequence
  peptide binding motif
GAMGSMAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQGIVQSDPPIPVDRTLIPSPPPRPKN

SEQ ID NO: 23 - protein, 67 aa, Artificial Sequence
  peptide binding motif
SYYHHHHHHLESTSLYKKAGSGSQKVEELKNKIAELENRNAVKKNRVAHLKQEIAYLKDELAAHEFE

SEQ ID NO: 24 - protein, 64 aa, Artificial Sequence
  peptide binding motif
SYYHHHHHHLESTSLYKKAGSGSFENVTHEFILATLENENAKLRRLEAKLERELARLRNEVAWL

SEQ ID NO: 25 - protein, 168 aa, Artificial Sequence
  peptide binding motif
AMADLEQKVLEMEASTYDGVFIWKISDFPRKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 26 - protein, 159 aa, Artificial Sequence
  peptide binding motif
ASIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVRKENQWC

SEQ ID NO: 27 - protein, 67 aa, Artificial Sequence
  peptide binding motif
SYYHHHHHHLESTSLYKKAGSGSNTVKELKNYIQELEERNAELKNLKEHLKFAKAELEFELAAHKFE

SEQ ID NO: 28 - protein, 77 aa, Artificial Sequence
  peptide binding motif
SYYHHHHHHLESTSLYKKAGSGSQKVAQLKNRVAYKLKENAKLENIVARLENDNANLEKDIANLEKDIANLERDVAR

SEQ ID NO: 29 - protein, 81 aa, Artificial Sequence
  peptide binding motif
LCTMKKGPSGYGFNLHSDKSKPGQFIRSVDPDSPAEASGLRAQDRIVEVNGVCMEGKQHGDVVSAIRAGGDETKLLVVDRE

SEQ ID NO: 30 - protein, 97 aa, Artificial Sequence
  peptide binding motif
SSGAIIYTVELKRYGGPLGITISGTEEPFDPIIISSLTKGGLAERTGAIHIGDRILAINSSSLKGKPLSEAIHLLQMAGETVTLKIKKQTDAQPASS

SEQ ID NO: 31 - protein, 109 aa, Artificial Sequence
  peptide binding motif
GNNLETYEWYNKSISRDKAEKLLLDTGKEGAFMVRDSRTPGTYTVSVFTKAIISENPCIKHYHIKETNDSPKRYYVAEKYVFDSIPLLIQYHQYNGGGLVTRLRYPVCG

SEQ ID NO: 32 - protein, 104 aa, Artificial Sequence
  peptide binding motif
GSHPWFFGKIPRAKAEEMLSKQRHDGAFLIRESESAPGDFSLSVKFGNDVQHFKVLRDGAGKYFLWVVKFNSLNELVDYHRSTSVSRNQQIFLRDIEQVPQQPT

SEQ ID NO: 33 - protein, 152 aa, Artificial Sequence [sequence omitted]

SEQ ID NO: 34 - protein, 57 aa, Artificial Sequence
  peptide binding motif
AEYVRALFDFNGNDEEDLPFKKGDILRIRDKPEEQWWNAEDSEGKRGMIPVPYVEKY

SEQ ID NO: 35 - protein, 60 aa, Artificial Sequence
  peptide binding motif
LIKHMRAEALFDFTGNSKLELNFKAGDVIFLLSRINKDWLEGTVRGATGIFPLSFVKILK

SEQ ID NO: 36 - protein, 153 aa, Artificial Sequence
  peptide binding motif
GSHMRLGAQSIQPTANLDRTDDLVYLNVMELVRAVLELKNELAQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAE

SEQ ID NO: 37 - protein, 70 aa, Artificial Sequence
  peptide binding motif
GAMATPGSENVLPREPLIATAVKFLQNSRVRQSPLATRRAFLKKKGLTDEEIDMAFQQSGTAADEPSSLW

SEQ ID NO: 38 - protein, 20 aa, Artificial Sequence
  peptide binding motif
RPPTISNPPPLISSAKHPSV

SEQ ID NO: 39 - protein, 20 aa, Artificial Sequence
  peptide binding motif
NFLQSRPEPTAPPEESFRSG

SEQ ID NO: 40 - protein, 20 aa, Artificial Sequence
  peptide binding motif
SKGTGLNPNAKVWQEIAPGN

SEQ ID NO: 41 - protein, 20 aa, Artificial Sequence
  peptide binding motifs
PDGGTTFEHLWSSLEPDSTY

SEQ ID NO: 42 - protein, 20 aa, Artificial Sequence
  peptide binding motif
PATSQHPPPPPGHRSQAPSH

SEQ ID NO: 43 - protein, 20 aa, Artificial Sequence
  peptide binding motif
ELNSLLILLEAAEYLERRDR

SEQ ID NO: 44 - protein, 20 aa, Artificial Sequence
  peptide binding motif
FQMPADTPPPAYLPPEDPMT

SEQ ID NO: 45 - protein, 20 aa, Artificial Sequence
  peptide binding motif
ERESNEEPPPPYEDPYWGNG

SEQ ID NO: 46 - protein, 20 aa, Artificial Sequence
  peptide binding motif
VSSTKLVSFHDDSDEDLLHI

SEQ ID NO: 47 - protein, 20 aa, Artificial Sequence
  peptide binding motif
AAATPISTFHDDSDEDLLHV

SEQ ID NO: 48 - protein, 20 aa, Artificial Sequence
  peptide binding motif
HDDSLPHPQQATDDSGHESD

SEQ ID NO: 49 - protein, 20 aa, Artificial Sequence
  peptide binding motif
GSPNAGSVEQTPKKPGLRRR

SEQ ID NO: 50 - protein, 20 aa, Artificial Sequence
  peptide binding motif
TDEEREETEEEVYLLNSTTL

SEQ ID NO: 51 - protein, 20 aa, Artificial Sequence
  peptide binding motif
DGNVSGTQRLDSATVRTYSC

SEQ ID NO: 52 - protein, 20 aa, Artificial Sequence
  peptide binding motif
ALVDDAADYEPPPSNNEEAL

SEQ ID NO: 53 - protein, 20 aa, Artificial Sequence
  peptide binding motif
RELFDDPSYVNVQNLDKARQ

SEQ ID NO: 54 - protein, 20 aa, Artificial Sequence
  peptide binding motif
KNTKSMNFDNPVYRKTTEEE

SEQ ID NO: 55 - protein, 20 aa, Artificial Sequence
  peptide binding motif
RSLPSTWIENKLYGMSDPNW

SEQ ID NO: 56 - protein, 20 aa, Artificial Sequence
  peptide binding motif
VVDNSPPPALPPKKRQSAPS

SEQ ID NO: 57 - protein, 20 aa, Artificial Sequence
  peptide binding motif
TQRSKPQPAVPPRPSADLIL

SEQ ID NO: 58 - protein, 20 aa, Artificial Sequence
  peptide binding motif
SATRELDELMASLSDFKIQG

SEQ ID NO: 59 - protein, 20 aa, Artificial Sequence
  peptide binding motif
DLALSENWAQEFLAAGDAVD

SEQ ID NO: 60 - protein, 16 aa, Artificial Sequence
  linker peptide
GSGSGSGSGSGSGSGS

SEQ ID NO: 61 - protein, 20 aa, Artificial Sequence
  linker peptide
GSGSGSGSGSGSGSGSGSGS

SEQ ID NO: 62 - protein, 30 aa, Artificial Sequence
  linker peptide
GSGSGSGSGSGSGSGSGSGSGSGSGSGSGS

SEQ ID NO: 63 - protein, 15 aa, Artificial Sequence
  linker peptide
GGGGSGGGGSGGGGS

SEQ ID NO: 64 - protein, 20 aa, Artificial Sequence
  linker peptide
GGGGSGGGGSGGGGSGGGGS

SEQ ID NO: 65 - protein, 10 aa, Artificial Sequence
  linker peptide
EAAAKEAAAK

SEQ ID NO: 66 - protein, 15 aa, Artificial Sequence
  linker peptide
EAAAKEAAAKEAAAK

SEQ ID NO: 67 - protein, 20 aa, Artificial Sequence
  linker peptide
EAAAKEAAAKEAAAKEAAAK

SEQ ID NO: 68 - protein, 6 aa, Artificial Sequence
  linker peptide
AAAGGM

SEQ ID NO: 69 - protein, 14 aa, Artificial Sequence
  linker peptide
AAAGGMPPAAAGGM

SEQ ID NO: 70 - protein, 6 aa, Artificial Sequence
  linker peptide
AAAGGM

SEQ ID NO: 71 - protein, 9 aa, Artificial Sequence
  linker peptide
PPAAAGGMM

SEQ ID NO: 72 - protein, 12 aa, Artificial Sequence
  linker peptide
GSAGSAAGSGEF

SEQ ID NO: 73 - protein, 18 aa, Artificial Sequence
  linker peptide
KLSGGGGSGGGGSGGGGS

SEQ ID NO: 74 - protein, 40 aa, Artificial Sequence
  linker peptide
GSAGSAAGSGEFGSAEAAAKEAAAKAGSAGSAAGSGEFGS

SEQ ID NO: 75 - protein, 36 aa, Artificial Sequence
  linker peptide
GSAGSAAGSGEFAEAAAKEAAAKAGSAGSAAGSGEF

SEQ ID NO: 76 - protein, 50 aa, Artificial Sequence
  linker peptide
GSAGSAAGSGEFGSAEAAAKEAAAKEAAAKEAAAKAGSAGSAAGSGEFGS

SEQ ID NO: 77 - protein, 211 aa, Artificial Sequence
  linker peptide
AEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSA

SEQ ID NO: 78 - protein, 16 aa, Artificial Sequence
  linker peptide
GGGGSGGGGSGGGGAS

SEQ ID NO: 79 - protein, 36 aa, Artificial Sequence
  linker peptide
GSAGSAAGSGEFGSAGSAAGSGEFGSAGSAAGSGEF

SEQ ID NO: 80 - protein, 116 aa, Artificial Sequence
  linker peptide
GSAGSAAGSGEFGSAEAAAKEAAAKEAAAKEAAAKAGSAGSAAGSGEFGSEQKLISEEDLEQKLISEEDLEQKLISEEDLGSAGSAAGSGEFGSAGSAAGSGEFGSAGSAAGSGEF

SEQ ID NO: 81 - protein, 110 aa, Artificial Sequence
  linker peptide
GSAGSAAGSGEFGSAEAAAKEAAAKEAAAKEAAAKAGSAGSAAGSGEFGSDYKDDDDKDYKDDDDKDYKDDDDKGSAGSAAGSGEFGSAGSAAGSGEFGSAGSAAGSGEF

SEQ ID NO: 82 - DNA, 30 bp, Artificial Sequence
  untranslated sequence
cggcacccctacaaacagaaggaatataaa

SEQ ID NO: 83 - protein, 1101 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 84 - protein, 394 aa, Escherichia coli
MKNCVIVSAVRTAIGSFNGSLASTSAIDLGATVIKAAIERAKIDSQHVDEVIMGNVLQAGLGQNPARQALLKSGLAETVCGFTVNKVCGSGLKSVALAAQAIQAGQAQSIVAGGMENMSLAPYLLDAKARSGYRLGDGQVYDVILRDGLMCATHGYHMGITAENVAKEYGITREMQDELALHSQRKAAAAIESGAFTAEIVPVNVVTRKKTFVFSQDEFPKANSTAEALGALRPAFDKAGTVTAGNASGINDGAAALVIMEESAALAAGLTPLARIKSYASGGVPPALMGMGPVPATQKALQLAGLQLADIDLIEANEAFAAQFLAVGKNLGFDSEKVNVNGGAIALGHPIGASGARILVTLLHAMQARDKTLGLATLCIGGGQGIAMVIERLN

SEQ ID NO: 85 - protein, 282 aa, Clostridium acetobutylicum
MKKVCVIGAGTMGSGIAQAFAAKGFEVVLRDIKDEFVDRGLDFINKNLSKLVKKGKIEEATKVEILTRISGTVDLNMAADCDLVIEAAVERMDIKKQIFADLDNICKPETILASNTSSLSITEVASATKRPDKVIGMHFFNPAPVMKLVEVIRGIATSQETFDAVKETSIAIGKDPVEVAEAPGFVVNRILIPMINEAVGILAEGIASVEDIDKAMKLGANHPMGPLELGDFIGLDICLAIMDVLYSETGDSKYRPHTLLKKYVRAGWLGRKSGKGFYDYSK

SEQ ID NO: 86 - protein, 261 aa, Clostridium acetobutylicum
MELNNVILEKEGKVAVVTINRPKALNALNSDTLKEMDYVIGEIENDSEVLAVILTGAGEKSFVAGADISEMKEMNTIEGRKFGILGNKVFRRLELLEKPVIAAVNGFALGGGCEIAMSCDIRIASSNARFGQPEVGLGITPGFGGTQRLSRLVGMGMAKQLIFTAQNIKADEALRIGLVNKVVEPSELMNTAKEIANKIVSNAPVAVKLSKQAINRGMQCDIDTALAFESEAFGECFSTEDQKDAMTAFIEKRKIEGFKNR

SEQ ID NO: 87 - protein, 394 aa, Cupriavidus necator
MTREVVVVSGVRTAIGTFGGSLKDVAPAELGALVVREALARAQVSGDDVGHVVFGNVIQTEPRDMYLGRVAAVNGGVTINAPALTVNRLCGSGLQAIVSAAQTILLGDTDVAIGGGAESMSRAPYLAPAARWGARMGDAGLVDMMLGALHDPFHRIHMGVTAENVAKEYDISRAQQDEAALESHRRASAAIKAGYFKDQIVPVVSKGRKGDVTFDTDEHVRHDATIDDMTKLRPVFVKENGTVTAGNASGLNDAAAAVVMMERAEAERRGLKPLARLVSYGHAGVDPKAMGIGPVPATKIALERAGLQVSDLDVIEANEAFAAQACAVTKALGLDPAKVNPNGSGISLGHPIGATGALITVKALHELNRVQGRYALVTMCIGGGQGIAAIFERI

SEQ ID NO: 88 - protein, 397 aa, Treponema denticola
MIVKPMVRNNICLNAHPQGCKKGVEDQIEYTKKRITAEVKAGAKAPKNVLVLGCSNGYGLASRITAAFGYGAATIGVSFEKAGSETKYGTPGWYNNLAFDEAAKREGLYSVTIDGDAFSDEIKAQVIEEAKKKGIKFDLIVYSLASPVRTDPDTGIMHKSVLKPFGKTFTGKTVDPFTGELKEISAEPANDEEAAATVKVMGGEDWERWIKQLSKEGLLEEGCITLAYSYIGPEATQALYRKGTIGKAKEHLEATAHRLNKENPSIRAFVSVNKGLVTRASAVIPVIPLYLASLFKVMKEKGNHEGCIEQITRLYAERLYRKDGTIPVDEENRIRIDDWELEEDVQKAVSALMEKVTGENAESLTDLAGYRHDFLASNGFDVEGINYEAEVERFDRI

SEQ ID NO: 89 - protein, 720 aa, Cannabis sativa
MGKNYKSLDSVVASDFIALGITSEVAETLHGRLAEIVCNYGAATPQTWINIANHILSPDLPFSLHQMLFYGCYKDFGPAPPAWIPDPEKVKSTNLGALLEKRGKEFLGVKYKDPISSFSHFQEFSVRNPEVYWRTVLMDEMKISFSKDPECILRRDDINNPGGSEWLPGGYLNSAKNCLNVNSNKKLNDTMIVWRDEGNDDLPLNKLTLDQLRKRVWLVGYALEEMGLEKGCAIAIDMPMHVDAVVIYLAIVLAGYVVVSIADSFSAPEISTRLRLSKAKAIFTQDHIIRGKKRIPLYSRVVEAKSPMAIVIPCSGSNIGAELRDGDISWDYFLERAKEFKNCEFTAREQPVDAYTNILFSSGTTGEPKAIPWTQATPLKAAADGWSHLDIRKGDVIVWPTNLGWMMGPWLVYASLLNGASIALYNGSPLVSGFAKFVQDAKVTMLGVVPSIVRSWKSTNCVSGYDWSTIRCFSSSGEASNVDEYLWLMGRANYKPVIEMCGGTEIGGAFSAGSFLQAQSLSSFSSQCMGCTLYILDKNGYPMPKNKPGIGELALGPVMFGASKTLLNGNHHDVYFKGMPTLNGEVLRRHGDIFELTSNGYYHAHGRADDTMNIGGIKISSIEIERVCNEVDDRVFETTAIGVPPLGGGPEQLVIFFVLKDSNDTTIDLNQLRLSFNLGLQKKLNPLFKVTRVVPLSSLPRTATNKIMRRVLRQQFSHFE

SEQ ID NO: 90 - protein, 491 aa, S. cerevisiae
MKLSTKLCWCGIKGRLRPQKQQQLHNTNLQMTELKKQKTAEQKTRPQNVGIKGIQIYIPTQCVNQSELEKFDGVSQGKYTIGLGQTNMSFVNDREDIYSMSLTVLSKLIKSYNIDTNKIGRLEVGTETLIDKSKSVKSVLMQLFGENTDVEGIDTLNACYGGTNALFNSLNWIESNAWDGRDAIVVCGDIAIYDKGAARPTGGAGTVAMWIGPDAPIVFDSVRASYMEHAYDFYKPDFTSEYPYVDGHFSLTCYVKALDQVYKSYSKKAISKGLVSDPAGSDALNVLKYFDYNVFHVPTCKLVTKSYGRLLYNDFRANPQLFPEVDAELATRDYDESLTDKNIEKTFVNVAKPFHKERVAQSLIVPTNTGNMYTASVYAAFASLLNYVGSDDLQGKRVGLFSYGSGLAASLYSCKIVGDVQHIIKELDITNKLAKRITETPKDYEAAIELRENAHLKKNFKPQGSIEHLQSGVYYLTNIDDKFRRSYDVKK

SEQ ID NO: 91 - protein, 381 aa, S. cerevisiae
MVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNR

SEQ ID NO: 92 - protein, 443 aa, S. cerevisiae
MSLPFLTSAPGKVIIFGEHSAVYNKPAVAASVSALRTYLLISESSAPDTIELDFPDISFNHKWSINDFNAITEDQVNSQKLAKAQQATDGLSQELVSLLDPLLAQLSESFHYHAAFCFLYMFVCLCPHAKNIKFSLKSTLPIGAGLGSSASISVSLALAMAYLGGLIGSNDLEKLSENDKHIVNQWAFIGEKCIHGTPSGIDNAVATYGNALLFEKDSHNGTINTNNFKFLDDFPAIPMILTYTRIPRSTKDLVARVRVLVTEKFPEVMKPILDAMGECALQGLEIMTKLSKCKGTDDEAVETNNELYEQLLELIRINHGLLVSIGVSHPGLELIKNLSDDLRIGSTKLTGAGGGGCSLTLLRRDITQEQIDSFKKKLQDDFSYETFETDLGGTGCCLLSAKNLNKDLKIKSLVFQLFENKTTTKQQIDDLLLPGNTNLPWTS

SEQ ID NO: 93 - protein, 452 aa, S. cerevisiae
MSELRAFSAPGKALLAGGYLVLDTKYEAFVVGLSARMHAVAHPYGSLQGSDKFEVRVKSKQFKDGEWLYHISPKSGFIPVSIGGSKNPFIEKVIANVFSYFKPNMDDYCNRNLFVIDIFSDDAYHSQEDSVTEHRGNRRLSFHSHRIEEVPKTGLGSSAGGLVTVLTTALASFFVSDLENNVDKYREVIHNLAQVAHCQAQGKIGSGFDVAAAAYGSIRYRRFPPALISNLPDIGSATYGSKLAHLVDEEDWNITIKSNHLPSGLTLWMGDIKNGSETVKLVQKVKNWYDSHMPESLKIYTELDHANSRFMDGLSKLDRLHETHDDYSDQIFESLERNDCTCQKYPEITEVRDAVATIRRSFRKITKESGADIEPPVQTSLLDDCQTLKGVLTCLIPGAGGYDAIAVITKQDVDLRAQTANDKRFSKVQWLDVTQADWGVRKEKDPETYLDK

SEQ ID NO: 94 - protein, 396 aa, S. cerevisiae
MTVYTASVTAPVNIATLKYWGKRDTKLNLPTNSSISVTLSQDDLRTLTSAATAPEFERDTLWLNGEPHSIDNERTQNCLRDLRQLRKEMESKDASLPTLSQWKLHIVSENNFPTAAGLASSAAGFAALVSAIAKLYQLPQSTSEISRIARKGSGSACRSLFGGYVAWEMGKAEDGHDSMAVQIADSSDWPQMKACVLVVSDIKKDVSSTQGMQLTVATSELFKERIEHVVPKRFEVMRKAIVEKDFATFAKETMMDSNSFHATCLDSFPPIFYMNDTSKRIISWCHTINQFYGETIVAYTFDAGPNAVLYYLAENESKLFAFIYKLFGSVPGWDKKFTTEQLEAFNHQFESSNFTARELDLELQKDVARVILTQVGSGPQETNESLIDAKTGLPKE

SEQ ID NO: 95 - protein, 288 aa, S. cerevisiae
MTADNNSMPHGAVSSYAKLVQNQTPEDILEEFPEIIPLQQRPNTRSSETSNDESGETCFSGHDEEQIKLMNENCIVLDWDDNAIGAGTKKVCHLMENIEKGLLHRAFSVFIFNEQGELLLQQRATEKITFPDLWTNTCCSHPLCIDDELGLKGKLDDKIKGAITAAVRKLDHELGIPEDETKTRGKFHFLNRIHYMAPSNEPWGEHEIDYILFYKINAKENLTVNPNVNEVRDFKWVSPNDLKTMFADPSYKFTPWFKIICENYLFNWWEQLDDLSEVENDRQIHRML

SEQ ID NO: 96 - protein, 335 aa, S. cerevisiae
MEAKIDELINNDPVWSSQNESLISKPYNHILLKPGKNFRLNLIVQINRVMNLPKDQLAIVSQIVELLHNSSLLIDDIEDNAPLRRGQTTSHLIWGVPSTINTANYMYFRAMQLVSQLTTKEPLYHWLITIFNEELINLHRGQGLDIYWRDFLPEIIPTQEMYLNMVMNKTGGLFRLTLRLMEALSPSSHHGHSLVPFINLLGIIYQIRDDYLNLKDFQMSSEKGFAEDITEGKLSFPIVHALNFTKTKGQTEQHNEILRILLLRTSDKDIKLKLIQILEFDTNSLAYTKNFINQLVNMIKNDNENKYLPDLASHSDTATNLHDELLYIIDHLSEL

SEQ ID NO: 97 - protein, 2233 aa, S. cerevisiae
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLSDGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVSVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLK

SEQ ID NO: 98 - protein, 385 aa, Cannabis sativa
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 99 - protein, 101 aa, Cannabis sativa
MAVKHLIVLKFKDEITEAQKEEFFKTYVNLVNIIPAMKDVYWGKDVTQKNKEEGYTHIVEVTFESVETIQDYIIHPAHVGFGDVYRSFWEKLLIFDYTPRK

SEQ ID NO: 100 - protein, 395 aa, Cannabis sativa
MGLSSVCTFSFQTNYHTLLNPHNNNPKTSLLCYRHPKTPIKYSYNNFPSKHCSTKSFHLQNKCSESLSIAKNSIRAATTNQTEPPESDNHSVATKILNFGKACWKLQRPYTIIAFTSCACGLFGKELLHNTNLISWSLMFKAFFFLVAILCIASFTTTINQIYDLHIDRINKPDLPLASGEISVNTAWIMSIIVALFGLIITIKMKGGPLYIFGYCFGIFGGIVYSVPPFRWKQNPSTAFLLNFLAHIITNFTFYYASRAALGLPFELRPSFTFLLAFMKSMGSALALIKDASDVEGDTKFGISTLASKYGSRNLTLFCSGIVLLSYVAAILAGIIWPQAFNSNVMLLSHAILAFWLILQTRDFALTNYDPEAGRRFYEFMWKLYYAEYLVYVFI

SEQ ID NO: 101 - protein, 544 aa, Cannabis sativa
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 102 - protein, 545 aa, Cannabis sativa
MNCSTFSFWFVCKIIFFFLSFNIQISIANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAACKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPRHH

SEQ ID NO: 103 - protein, 1529 aa, Artificial Sequence
  chimeric enzyme
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSMKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASSYYHHHHHHLESTSLYKKAGSGSNLVAQLENEVASLENENETLKKKNLHKKDLIAYLEKEIANLRKKIEEGSAGSAAGSGEFGSAEAAAKEAAAKAGSAGSAAGSGEFGSSYYHHHHHHLESTSLYKKAGSGSARNAYLRKKIARLKKDNLQLERDEQNLEKIIANLRDEIARLENEVASHEQ

SEQ ID NO: 104 - protein, 821 aa, Artificial Sequence
  chimeric enzyme
MKNCVIVSAVRTAIGSFNGSLASTSAIDLGATVIKAAIERAKIDSQHVDEVIMGNVLQAGLGQNPARQALLKSGLAETVCGFTVNKVCGSGLKSVALAAQAIQAGQAQSIVAGGMENMSLAPYLLDAKARSGYRLGDGQVYDVILRDGLMCATHGYHMGITAENVAKEYGITREMQDELALHSQRKAAAAIESGAFTAEIVPVNVVTRKKTFVFSQDEFPKANSTAEALGALRPAFDKAGTVTAGNASGINDGAAALVIMEESAALAAGLTPLARIKSYASGGVPPALMGMGPVPATQKALQLAGLQLADIDLIEANEAFAAQFLAVGKNLGFDSEKVNVNGGAIALGHPIGASGARILVTLLHAMQARDKTLGLATLCIGGGQGIAMVIERLNKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASSYYHHHHHHLESTSLYKKAGSGSNEVTTLENDAAFIENENAYLEKEIARLRKEKAALRNRLAHKKGSAGSAAGSGEFGSAEAAAKEAAAKAGSAGSAAGSGEFGSSYYHHHHHHLESTSLYKKAGSGSQKVAELKNRVAVKLNRNEQLKNKVEELKNRNAYLKNELATLENEVARLENDVAE

SEQ ID NO: 105 - protein, 776 aa, Artificial Sequence
  chimeric enzyme
MKKVCVIGAGTMGSGIAQAFAAKGFEVVLRDIKDEFVDRGLDFINKNLSKLVKKGKIEEATKVEILTRISGTVDLNMAADCDLVIEAAVERMDIKKQIFADLDNICKPETILASNTSSLSITEVASATKRPDKVIGMHFFNPAPVMKLVEVIRGIATSQETFDAVKETSIAIGKDPVEVAEAPGFVVNRILIPMINEAVGILAEGIASVEDIDKAMKLGANHPMGPLELGDFIGLDICLAIMDVLYSETGDSKYRPHTLLKKYVRAGWLGRKSGKGFYDYSKKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASENLYFQGENLYFQGDSSESCWNCGRKASETCSGCNTARYCGSFCQHKDWEKHHHICGQTLQAQQGSAGSAAGSGEFGSAEAAAKEAAAKAGSAGSAAGSGEFGSMAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRP

SEQ ID NO: 106 - protein, 741 aa, Artificial Sequence
  chimeric enzyme
MELNNVILEKEGKVAVVTINRPKALNALNSDTLKEMDYVIGEIENDSEVLAVILTGAGEKSFVAGADISEMKEMNTIEGRKFGILGNKVFRRLELLEKPVIAAVNGFALGGGCEIAMSCDIRIASSNARFGQPEVGLGITPGFGGTQRLSRLVGMGMAKQLIFTAQNIKADEALRIGLVNKVVEPSELMNTAKEIANKIVSNAPVAVKLSKQAINRGMQCDIDTALAFESEAFGECFSTEDQKDAMTAFIEKRKIEGFKNRKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASGPLGSPLTASMLASAPPQEQKQMLGERLFPLIQAMHPTLAGKITGMLLEIDNSELLHMLESPESLRSKVDEAVAVLQAHQAKEAAQKAGSAGSAAGSGEFGSAEAAAKEAAAKAGSAGSAAGSGEFGSNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVV

SEQ ID NO: 107 - protein, 820 aa, Artificial Sequence
  chimeric enzyme
MIVKPMVRNNICLNAHPQGCKKGVEDQIEYTKKRITAEVKAGAKAPKNVLVLGCSNGYGLASRITAAFGYGAATIGVSFEKAGSETKYGTPGWYNNLAFDEAAKREGLYSVTIDGDAFSDEIKAQVIEEAKKKGIKFDLIVYSLASPVRTDPDTGIMHKSVLKPFGKTFTGKTVDPFTGELKEISAEPANDEEAAATVKVMGGEDWERWIKQLSKEGLLEEGCITLAYSYIGPEATQALYRKGTIGKAKEHLEATAHRLNKENPSIRAFVSVNKGLVTRASAVIPVIPLYLASLFKVMKEKGNHEGCIEQITRLYAERLYRKDGTIPVDEENRIRIDDWELEEDVQKAVSALMEKVTGENAESLTDLAGYRHDFLASNGFDVEGINYEAEVERFDRIKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASSYYHHHHHHLESTSLYKKAGSGSNLLATLRSTAAVLENENHVLEKEKEKLRKEKEQLLNKLEAYKGSAGSAAGSGEFGSAEAAAKEAAAKAGSAGSAAGSGEFGSSYYHHHHHHLESTSLYKKAGSGSKRIAYLRKKIAALKKDNANLEKDIANLENEIERLIKEIKTLENEVASHEQ

SEQ ID NO: 108 - protein, 826 aa, Artificial Sequence
  chimeric enzyme
MTREVVVVSGVRTAIGTFGGSLKDVAPAELGALVVREALARAQVSGDDVGHVVFGNVIQTEPRDMYLGRVAAVNGGVTINAPALTVNRLCGSGLQAIVSAAQTILLGDTDVAIGGGAESMSRAPYLAPAARWGARMGDAGLVDMMLGALHDPFHRIHMGVTAENVAKEYDISRAQQDEAALESHRRASAAIKAGYFKDQIVPVVSKGRKGDVTFDTDEHVRHDATIDDMTKLRPVFVKENGTVTAGNASGLNDAAAAVVMMERAEAERRGLKPLARLVSYGHAGVDPKAMGIGPVPATKIALERAGLQVSDLDVIEANEAFAAQACAVTKALGLDPAKVNPNGSGISLGHPIGATGALITVKALHELNRVQGRYALVTMCIGGGQGIAAIFERIKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASDVMWEYKWENTGDAELYGPFTSAQMQTWVSEGYFPDGVYCRKLDPPGGQFYNSKRIDFDLYTGSAGSAAGSGEFGSAEAAAKEAAAKAGSAGSAAGSGEFGSESDSVEFNNAISYVNKIKTRFLDHPEIYRSFLEILHTYQKEQLHTKGRPFRGMSEEEVFTEVANLFRGQEDLLSEFGQFLPEAKR

SEQ ID NO: 109 - protein, 849 aa, Artificial Sequence
  chimeric enzyme
MKLSTKLCWCGIKGRLRPQKQQQLHNTNLQMTELKKQKTAEQKTRPQNVGIKGIQIYIPTQCVNQSELEKFDGVSQGKYTIGLGQTNMSFVNDREDIYSMSLTVLSKLIKSYNIDTNKIGRLEVGTETLIDKSKSVKSVLMQLFGENTDVEGIDTLNACYGGTNALFNSLNWIESNAWDGRDAIVVCGDIAIYDKGAARPTGGAGTVAMWIGPDAPIVFDSVRASYMEHAYDFYKPDFTSEYPYVDGHFSLTCYVKALDQVYKSYSKKAISKGLVSDPAGSDALNVLKYFDYNVFHVPTCKLVTKSYGRLLYNDFRANPQLFPEVDAELATRDYDESLTDKNIEKTFVNVAKPFHKERVAQSLIVPTNTGNMYTASVYAAFASLLNYVGSDDLQGKRVGLFSYGSGLAASLYSCKIVGDVQHIIKELDITNKLAKRITETPKDYEAAIELRENAHLKKNFKPQGSIEHLQSGVYYLTNIDDKFRRSYDVKKKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASLGPLPPGWEVRSTVSGRIYFVDHNNRTTQFTDPRLHGSAGSAAGSGEFGSAEAAAKEAAAKAGSAGSAAGSGEFGSGAMGPLPPGWEKRTDSNGRVYFVNHNTRITQWEDPRS

SEQ ID NO: 110 - protein, 826 aa, Artificial Sequence
  chimeric enzyme
MVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASSYYHHHHHHLESTSLYKKAGSEFFRRERNKMAAAKCRNRRRELTDTLQAETDQLEDEKSALQTEIANLLKEKEKLEFILAAHRPACKIPDDLGFPEEMSLEGSAGSAAGSGEFGSAEAAAKEAAAKAGSAGSAAGSGEFGSSYYHHHHHHLESTSLYKKAGSGSQKVESLKQKIEELKQRKAQLKNDIANLEKEIAYAET

SEQ ID NO: 111 - protein, 1046 aa, Artificial Sequence
  chimeric enzyme
MSLPFLTSAPGKVIIFGEHSAVYNKPAVAASVSALRTYLLISESSAPDTIELDFPDISFNHKWSINDFNAITEDQVNSQKLAKAQQATDGLSQELVSLLDPLLAQLSESFHYHAAFCFLYMFVCLCPHAKNIKFSLKSTLPIGAGLGSSASISVSLALAMAYLGGLIGSNDLEKLSENDKHIVNQWAFIGEKCIHGTPSGIDNAVATYGNALLFEKDSHNGTINTNNFKFLDDFPAIPMILTYTRIPRSTKDLVARVRVLVTEKFPEVMKPILDAMGECALQGLEIMTKLSKCKGTDDEAVETNNELYEQLLELIRINHGLLVSIGVSHPGLELIKNLSDDLRIGSTKLTGAGGGGCSLTLLRRDITQEQIDSFKKKLQDDFSYETFETDLGGTGCCLLSAKNLNKDLKIKSLVFQLFENKTTTKQQIDDLLLPGNTNLPWTSKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASMEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSGSAGSAAGSGEFGSAEAAAKEAAAKAGSAGSAAGSGEFGSGAMGSMAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQGIVQSDPPIPVDRTLIPSPPPRPKN

SEQ ID NO: 112 - protein, 868 aa, Artificial Sequence
  chimeric enzyme
MSELRAFSAPGKALLAGGYLVLDTKYEAFVVGLSARMHAVAHPYGSLQGSDKFEVRVKSKQFKDGEWLYHISPKSGFIPVSIGGSKNPFIEKVIANVFSYFKPNMDDYCNRNLFVIDIFSDDAYHSQEDSVTEHRGNRRLSFHSHRIEEVPKTGLGSSAGGLVTVLTTALASFFVSDLENNVDKYREVIHNLAQVAHCQAQGKIGSGFDVAAAAYGSIRYRRFPPALISNLPDIGSATYGSKLAHLVDEEDWNITIKSNHLPSGLTLWMGDIKNGSETVKLVQKVKNWYDSHMPESLKIYTELDHANSRFMDGLSKLDRLHETHDDYSDQIFESLERNDCTCQKYPEITEVRDAVATIRRSFRKITKESGADIEPPVQTSLLDDCQTLKGVLTCLIPGAGGYDAIAVITKQDVDLRAQTANDKRFSKVQWLDVTQADWGVRKEKDPETYLDKKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASSYYHHHHHHLESTSLYKKAGSGSQKVEELKNKIAELENRNAVKKNRVAHLKQEIAYLKDELAAHEFEGSAGSAAGSGEFGSAEAAAKEAAAKAGSAGSAAGSGEFGSSYYHHHHHHLESTSLYKKAGSGSFENVTHEFILATLENENAKLRRLEAKLERELARLRNEVAWL

SEQ ID NO: 113 - protein, 1008 aa, Artificial Sequence
  chimeric enzyme
MTVYTASVTAPVNIATLKYWGKRDTKLNLPTNSSISVTLSQDDLRTLTSAATAPEFERDTLWLNGEPHSIDNERTQNCLRDLRQLRKEMESKDASLPTLSQWKLHIVSENNFPTAAGLASSAAGFAALVSAIAKLYQLPQSTSEISRIARKGSGSACRSLFGGYVAWEMGKAEDGHDSMAVQIADSSDWPQMKACVLVVSDIKKDVSSTQGMQLTVATSELFKERIEHVVPKRFEVMRKAIVEKDFATFAKETMMDSNSFHATCLDSFPPIFYMNDTSKRIISWCHTINQFYGETIVAYTFDAGPNAVLYYLAENESKLFAFIYKLFGSVPGWDKKFTTEQLEAFNHQFESSNFTARELDLELQKDVARVILTQVGSGPQETNESLIDAKTGLPKEKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASAMADLEQKVLEMEASTYDGVFIWKISDFPRKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGLGSAGSAAGSGEFGSAEAAAKEAAAKAGSAGSAAGSGEFGSASIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVRKENQWC

SEQ ID NO: 114 - protein, 717 aa, Artificial Sequence
  chimeric enzyme
MTADNNSMPHGAVSSYAKLVQNQTPEDILEEFPEIIPLQQRPNTRSSETSNDESGETCFSGHDEEQIKLMNENCIVLDWDDNAIGAGTKKVCHLMENIEKGLLHRAFSVFIFNEQGELLLQQRATEKITFPDLWTNTCCSHPLCIDDELGLKGKLDDKIKGAITAAVRKLDHELGIPEDETKTRGKFHFLNRIHYMAPSNEPWGEHEIDYILFYKINAKENLTVNPNVNEVRDFKWVSPNDLKTMFADPSYKFTPWFKIICENYLFNWWEQLDDLSEVENDRQIHRMLKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASSYYHHHHHHLESTSLYKKAGSGSNTVKELKNYIQELEERNAELKNLKEHLKFAKAELEFELAAHKFEGSAGSAAGSGEFGSAEAAAKEAAAKAGSAGSAAGSGEFGSSYYHHHHHHLESTSLYKKAGSGSQKVAQLKNRVAYKLKENAKLENIVARLENDNANLEKDIANLEKDIANLERDVAR

SEQ ID NO: 115 - protein, 798 aa, Artificial Sequence
  chimeric enzyme
MEAKIDELINNDPVWSSQNESLISKPYNHILLKPGKNFRLNLIVQINRVMNLPKDQLAIVSQIVELLHNSSLLIDDIEDNAPLRRGQTTSHLIWGVPSTINTANYMYFRAMQLVSQLTTKEPLYHWLITIFNEELINLHRGQGLDIYWRDFLPEIIPTQEMYLNMVMNKTGGLFRLTLRLMEALSPSSHHGHSLVPFINLLGIIYQIRDDYLNLKDFQMSSEKGFAEDITEGKLSFPIVHALNFTKTKGQTEQHNEILRILLLRTSDKDIKLKLIQILEFDTNSLAYTKNFINQLVNMIKNDNENKYLPDLASHSDTATNLHDELLYIIDHLSELKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASLCTMKKGPSGYGFNLHSDKSKPGQFIRSVDPDSPAEASGLRAQDRIVEVNGVCMEGKQHGDVVSAIRAGGDETKLLVVDREGSAGSAAGSGEFGSAEAAAKEAAAKAGSAGSAAGSGEFGSSSGAIIYTVELKRYGGPLGITISGTEEPFDPIIISSLTKGGLAERTGAIHIGDRILAINSSSLKGKPLSEAIHLLQMAGETVTLKIKKQTDAQPASS

SEQ ID NO: 116 - protein, 883 aa, Artificial Sequence
  chimeric enzyme
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKYKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASGNNLETYEWYNKSISRDKAEKLLLDTGKEGAFMVRDSRTPGTYTVSVFTKAIISENPCIKHYHIKETNDSPKRYYVAEKYVFDSIPLLIQYHQYNGGGLVTRLRYPVCGGSAGSAAGSGEFGSAEAAAKEAAAKAGSAGSAAGSGEFGSGSHPWFFGKIPRAKAEEMLSKQRHDGAFLIRESESAPGDFSLSVKFGNDVQHFKVLRDGAGKYFLWVVKFNSLNELVDYHRSTSVSRNQQIFLRDIEQVPQQPT

SEQ ID NO: 117 - protein, 665 aa, Artificial Sequence
  chimeric enzyme
MAVKHLIVLKFKDEITEAQKEEFFKTYVNLVNIIPAMKDVYWGKDVTQKNKEEGYTHIVEVTFESVETIQDYIIHPAHVGFGDVYRSFWEKLLIFDYTPRKKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAGSAGSAAGSGEFGSAEAAAKEAAAKAGSAGSAAGSGEFGSGSHMGSQFWVTSQKTEASERCGLQGSYILRVEAEKLTLLTLGAQSQILEPLLFWPYTLLRRYGRDKVMFSFEAGRRCPSGPGTFTFQTSQGNDIFQAVEAAIQQQKAQGKVGQAQDILRLEHHHHHH

SEQ ID NO: 118 - protein, 797 aa, Artificial Sequence
  chimeric enzyme
MGLSSVCTFSFQTNYHTLLNPHNNNPKTSLLCYRHPKTPIKYSYNNFPSKHCSTKSFHLQNKCSESLSIAKNSIRAATTNQTEPPESDNHSVATKILNFGKACWKLQRPYTIIAFTSCACGLFGKELLHNTNLISWSLMFKAFFFLVAILCIASFTTTINQIYDLHIDRINKPDLPLASGEISVNTAWIMSIIVALFGLIITIKMKGGPLYIFGYCFGIFGGIVYSVPPFRWKQNPSTAFLLNFLAHIITNFTFYYASRAALGLPFELRPSFTFLLAFMKSMGSALALIKDASDVEGDTKFGISTLASKYGSRNLTLFCSGIVLLSYVAAILAGIIWPQAFNSNVMLLSHAILAFWLILQTRDFALTNYDPEAGRRFYEFMWKLYYAEYLVYVFIKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASAEYVRALFDFNGNDEEDLPFKKGDILRIRDKPEEQWWNAEDSEGKRGMIPVPYVEKYGSAGSAAGSGEFGSAEAAAKEAAAKAGSAGSAAGSGEFGSLIKHMRAEALFDFTGNSKLELNFKAGDVIFLLSRINKDWLEGTVRGATGIFPLSFVKILK

SEQ ID NO: 119 - protein, 3620 aa, Artificial Sequence
  scaffold polypeptide
MGSAGSAAGSGEFGSAGSAAGSGEFGSAGSAAGSGEFSYYHHHHHHLESTSLYKKAGSGSARNAYLRKKIARLKKDNLQLERDEQNLEKIIANLRDEIARLENEVASHEQGSAGSAAGSGEFAEAAAKEAAAKAGSAGSAAGSGEFSYYHHHHHHLESTSLYKKAGSGSNLVAQLENEVASLENENETLKKKNLHKKDLIAYLEKEIANLRKKIEEGSAGSAAGSGEFGSAEAAAKEAAAKEAAAKEAAAKAGSAGSAAGSGEFGSSYYHHHHHHLESTSLYKKAGSGSQKVAELKNRVAVKLNRNEQLKNKVEELKNRNAYLKNELATLENEVARLENDVAEGSAGSAAGSGEFAEAAAKEAAAKAGSAGSAAGSGEFSYYHHHHHHLESTSLYKKAGSGSNEVTTLENDAAFIENENAYLEKEIARLRKEKAALRNRLAHKKGSAGSAAGSGEFGSAEAAAKEAAAKEAAAKEAAAKAGSAGSAAGSGEFGSRPPTISNPPPLISSAKHPSVGSAGSAAGSGEFAEAAAKEAAAKAGSAGSAAGSGEFNFLQSRPEPTAPPEESFRSGGSAGSAAGSGEFGSAEAAAKEAAAKEAAAKEAAAKAGSAGSAAGSGEFGSSKGTGLNPNAKVWQEIAPGNGSAGSAAGSGEFAEAAAKEAAAKAGSAGSAAGSGEFPDGGTTFEHLWSSLEPDSTYGSAGSAAGSGEFGSAEAAAKEAAAKEAAAKEAAAKAGSAGSAAGSGEFGSSYYHHHHHHLESTSLYKKAGSGSKRIAYLRKKIAALKKDNANLEKDIANLENEIERLIKEIKTLENEVASHEQGSAGSAAGSGEFAEAAAKEAAAKAGSAGSAAGSGEFSYYHHHHHHLESTSLYKKAGSGSNLLATLRSTAAVLENENHVLEKEKEKLRKEKEQLLNKLEAYKGSAGSAAGSGEFGSAEAAAKEAAAKEAAAKEAAAKAGSAGSAAGSGEFGSPATSQHPPPPPGHRSQAPSHGSAGSAAGSGEFAEAAAKEAAAKAGSAGSAAGSGEFELNSLLILLEAAEYLERRDRGSAGSAAGSGEFGSAEAAAKEAAAKEAAAKEAAAKAGSAGSAAGSGEFGSRPPTISNPPPLISSAKHPSVGSAGSAAGSGEFAEAAAKEAAAKAGSAGSAAGSGEFNFLQSRPEPTAPPEESFRSGGSAGSAAGSGEFGSAEAAAKEAAAKEAAAKEAAAKAGSAGSAAGSGEFGSSKGTGLNPNAKVWQEIAPGNGSAGSAAGSGEFAEAAAKEAAAKAGSAGSAAGSGEFPDGGTTFEHLWSSLEPDSTYGSAGSAAGSGEFGSAEAAAKEAAAKEAAAKEAAAKAGSAGSAAGSGEFGSSYYHHHHHHLESTSLYKKAGSGSKRIAYLRKKIAALKKDNANLEKDIANLENEIERLIKEIKTLENEVASHEQGSAGSAAGSGEFAEAAAKEAAAKAGSAGSAAGSGEFSYYHHHHHHLESTSLYKKAGSGSNLLATLRSTAAVLENENHVLEKEKEKLRKEKEQLLNKLEAYKGSAGSAAGSGEFGSAEAAAKEAAAKEAAAKEAAAKAGSAGSAAGSGEFGSALVDDAADYEPPPSNNEEALGSAGSAAGSGEFAEAAAKEAAAKAGSAGSAAGSGEFRELFDDPSYVNVQNLDKARQGSAGSAAGSGEFGSAEAAAKEAAAKEAAAKEAAAKAGSAGSAAGSGEFGSKNTKSMNFDNPVYRKTTEEEGSAGSAAGSGEFAEAAAKEAAAKAGSAGSAAGSGEFRSLPSTWIENKLYGMSDPNWGSAGSAAGSGEFGSAEAAAKEAAAKEAAAKEAAAKAGSAGSAAGSGEFGSVVDNSPPPALPPKKRQSAPSGSAGSAAGSGEFAEAAAKEAAAKAGSAGSAAGSGEFTQRSKPQPAVPPRPSADLILGSAGSAAGSGEFGSAEAAAKEAAAKEAAAKEAAAKAGSAGSAAGSGEFGSTDEEREETEEEVYLLNSTTLGSAGSAAGSGEFAEAAAKEAAAKAGSAGSAAGSGEFDGNVSGTQRLDSATVRTYSCGSAGSAAGSGEFGSAEAAAKEAAAKEAAAKEAAAKAGSAGSAAGSGEFGSSYYHHHHHHLESTSLYKKAGSGSQKVAQLKNRVAYKLKENAKLENIVARLENDNANLEKDIANLEKDIANLERDVARGSAGSAAGSGEFAEAAAKEAAAKAGSAGSAAGSGEFSYYHHHHHHLESTSLYKKAGSGSNTVKELKNYIQELEERNAELKNLKEHLKFAKAELEFELAAHKFEGSAGSAAGSGEFGSAEAAAKEAAAKEAAAKEAAAKAGSAGSAAGSGEFGSHDDSLPHPQQATDDSGHESDGSAGSAAGSGEFAEAAAKEAAAKAGSAGSAAGSGEFGSPNAGSVEQTPKKPGLRRRGSAGSAAGSGEFGSAEAAAKEAAAKEAAAKEAAAKAGSAGSAAGSGEFGSSYYHHHHHHLESTSLYKKAGSGSFENVTHEFILATLENENAKLRRLEAKLERELARLRNEVAWLGSAGSAAGSGEFAEAAAKEAAAKAGSAGSAAGSGEFSYYHHHHHHLESTSLYKKAGSGSQKVEELKNKIAELENRNAVKKNRVAHLKQEIAYLKDELAAHEFEGSAGSAAGSGEFGSAEAAAKEAAAKEAAAKEAAAKAGSAGSAAGSGEFGSVSSTKLVSFHDDSDEDLLHIGSAGSAAGSGEFAEAAAKEAAAKAGSAGSAAGSGEFAAATPISTFHDDSDEDLLHVGSAGSAAGSGEFGSAEAAAKEAAAKEAAAKEAAAKAGSAGSAAGSGEFGSSYYHHHHHHLESTSLYKKAGSGSQKVESLKQKIEELKQRKAQLKNDIANLEKEIAYAETGSAGSAAGSGEFAEAAAKEAAAKAGSAGSAAGSGEFSYYHHHHHHLESTSLYKKAGSEFFRRERNKMAAAKCRNRRRELTDTLQAETDQLEDEKSALQTEIANLLKEKEKLEFILAAHRPACKIPDDLGFPEEMSLEGSAGSAAGSGEFGSAEAAAKEAAAKEAAAKEAAAKAGSAGSAAGSGEFGSFQMPADTPPPAYLPPEDPMTGSAGSAAGSGEFAEAAAKEAAAKAGSAGSAAGSGEFERESNEEPPPPYEDPYWGNGGSAGSAAGSGEFGSAEAAAKEAAAKEAAAKEAAAKAGSAGSAAGSGEFGSSYYHHHHHHLESTSLYKKAGSGSQKVAELKNRVAVKLNRNEQLKNKVEELKNRNAYLKNELATLENEVARLENDVAEGSAGSAAGSGEFAEAAAKEAAAKAGSAGSAAGSGEFSYYHHHHHHLESTSLYKKAGSGSNEVTTLENDAAFIENENAYLEKEIARLRKEKAALRNRLAHKKSYYHHHHHHLESTSLYKKAGSGSARNAYLRKKIARLKKDNLQLERDEQNLEKIIANLRDEIARLENEVASHEQGSAGSAAGSGEFAEAAAKEAAAKAGSAGSAAGSGEFSYYHHHHHHLESTSLYKKAGSGSNLVAQLENEVASLENENETLKKKNLHKKDLIAYLEKEIANLRKKIEEGSAGSAAGSGEFGSAEAAAKEAAAKEAAAKEAAAKAGSAGSAAGSGEFGSEQKLISEEDLEQKLISEEDLEQKLISEEDLGSAGSAAGSGEFGSAGSAAGSGEFGSAGSAAGSGEF

SEQ ID NO: 120 - protein, 452 aa, Artificial Sequence
  scaffold polypeptide
MGSAGSAAGSGEFGSAGSAAGSGEFGSAGSAAGSGEFSYYHHHHHHLESTSLYKKAGSGSARNAYLRKKIARLKKDNLQLERDEQNLEKIIANLRDEIARLENEVASHEQGSAGSAAGSGEFAEAAAKEAAAKAGSAGSAAGSGEFSYYHHHHHHLESTSLYKKAGSGSNLVAQLENEVASLENENETLKKKNLHKKDLIAYLEKEIANLRKKIEEGSAGSAAGSGEFGSAEAAAKEAAAKEAAAKEAAAKAGSAGSAAGSGEFGSSATRELDELMASLSDFKIQGGSAGSAAGSGEFAEAAAKEAAAKAGSAGSAAGSGEFDLALSENWAQEFLAAGDAVDGSAGSAAGSGEFGSAEAAAKEAAAKEAAAKEAAAKAGSAGSAAGSGEFGSDYKDDDDKDYKDDDDKDYKDDDDKGSAGSAAGSGEFGSAGSAAGSGEFGSAGSAAGSGEF

SEQ ID NO: 121 - DNA, 3303 bp, Artificial Sequence
  codon optimized
atgtctgctaaagctatttctgaacaaactggtaaagaattgttgtataaatttatttgtactacttctgctattcaaaatagatttaaatatgctagagttactccagatactgattgggctagattgttgcaagatcatccatggttgttgtctcaaaatttggttgttaaaccagatcaattgattaaaagaagaggtaaattgggtttggttggtgttaatttgactttggatggtgttaaatcttggttgaaaccaagattgggtcaagaagctactgttggtaaagctactggttttttgaaaaattttttgattgaaccatttgttccacattctcaagctgaagaattttatgtttgtatttatgctactagagaaggtgattatgttttgtttcatcatgaaggtggtgttgatgttggtgatgttgatgctaaagctcaaaaattgttggttggtgttgatgaaaaattgaatccagaagatattaaaaaacatttgttggttcatgctccagaagataaaaaagaaattttggcttcttttatttctggtttgtttaatttttatgaagatttgtattttacttatttggaaattaatccattggttgttactaaagatggtgtttatgttttggatttggctgctaaagttgatgctactgctgattatatttgtaaagttaaatggggtgatattgaatttccaccaccatttggtagagaagcttatccagaagaagcttatattgctgatttggatgctaaatctggtgcttctttgaaattgactttgttgaatccaaaaggtagaatttggactatggttgctggtggtggtgcttctgttgtttattctgatactatttgtgatttgggtggtgttaatgaattggctaattatggtgaatattctggtgctccatctgaacaacaaacttatgattatgctaaaactattttgtctttgatgactagagaaaaacatccagatggtaaaattttgattattggtggttctattgctaattttactaatgttgctgctacttttaaaggtattgttagagctattagagattatcaaggtccattgaaagaacatgaagttactatttttgttagaagaggtggtccaaattatcaagaaggtttgagagttatgggtgaagttggtaaaactactggtattccaattcatgtttttggtactgaaactcatatgactgctattgttggtatggctttgggtcatagaccaattccaaatcaaccaccaactgctgctcatactgctaattttttgttgaatgcttctggttctacttctactccagctccatctagaactgcttctttttctgaatctagagctgatgaagttgctccagctaaaaaagctaaaccagctatgccacaagattctgttccatctccaagatctttgcaaggtaaatctactactttgttttctagacatactaaagctattgtttggggtatgcaaactagagctgttcaaggtatgttggattttgattatgtttgttctagagatgaaccatctgttgctgctatggtttatccatttactggtgatcataaacaaaaattttattggggtcataaagaaattttgattccagtttttaaaaatatggctgatgctatgagaaaacatccagaagttgatgttttgattaattttgcttctttgagatctgcttatgattctactatggaaactatgaattatgctcaaattagaactattgctattattgctgaaggtattccagaagctttgactagaaaattgattaaaaaagctgatcaaaaaggtgttactattattggtccagctactgttggtggtattaaaccaggttgttttaaaattggtaatactggtggtatgttggataatattttggcttctaaattgtatagaccaggttctgttgcttatgtttctagatctggtggtatgtctaatgaattgaataatattatttctagaactactgatggtgtttatgaaggtgttgctattggtggtgatagatatccaggttctacttttatggatcatgttttgagatatcaagatactccaggtgttaaaatgattgttgttttgggtgaaattggtggtactgaagaatataaaatttgtagaggtattaaagaaggtagattgactaaaccaattgtttgttggtgtattggtacttgtgctactatgttttcttctgaagttcaatttggtcatgctggtgcttgtgctaatcaagcttctgaaactgctgttgctaaaaatcaagctttgaaagaagctggtgtttttgttccaagatcttttgatgaattgggtgaaattattcaatctgtttatgaagatttggttgctaatggtgttattgttccagctcaagaagttccaccaccaactgttccaatggattattcttgggctagagaattgggtttgattagaaaaccagcttcttttatgacttctatttgtgatgaaagaggtcaagaattgatttatgctggtatgccaattactgaagtttttaaagaagaaatgggtattggtggtgttttgggtttgttgtggtttcaaaaaagattgccaaaatattcttgtcaatttattgaaatgtgtttgatggttactgctgatcatggtccagctgtttctggtgctcataatactattatttgtgctagagctggtaaagatttggtttcttctttgacttctggtttgttgactattggtgatagatttggtggtgctttggatgctgctgctaaaatgttttctaaagcttttgattctggtattattccaatggaatttgttaataaaatgaaaaaagaaggtaaattgattatgggtattggtcatagagttaaatctattaataatccagatatgagagttcaaattttgaaagattatgttagacaacattttccagctactccattgttggattatgctttggaagttgaaaaaattactacttctaaaaaaccaaatttgattttgaatgttgatggtttgattggtgttgcttttgttgatatgttgagaaattgtggttcttttactagagaagaagctgatgaatatattgatattggtgctttgaatggtatttttgttttgggtagatctatgggttttattggtcattatttggatcaaaaaagattgaaacaaggtttgtatagacatccatgggatgatatttcttatgttttgccagaacatatgtctatg

SEQ ID NO: 122 - DNA, 1182 bp, Artificial Sequence
  codon optimized
atgaaaaattgtgttattgtttctgctgttagaactgctattggttcttttaatggttctttggcttctacttctgctattgatttgggtgctactgttattaaagctgctattgaaagagctaaaattgattctcaacatgttgatgaagttattatgggtaatgttttgcaagctggtttgggtcaaaatccagctagacaagctttgttgaaatctggtttggctgaaactgtttgtggttttactgttaataaagtttgtggttctggtttgaaatctgttgctttggctgctcaagctattcaagctggtcaagctcaatctattgttgctggtggtatggaaaatatgtctttggctccatatttgttggatgctaaagctagatctggttatagattgggtgatggtcaagtttatgatgttattttgagagatggtttgatgtgtgctactcatggttatcatatgggtattactgctgaaaatgttgctaaagaatatggtattactagagaaatgcaagatgaattggctttgcattctcaaagaaaagctgctgctgctattgaatctggtgcttttactgctgaaattgttccagttaatgttgttactagaaaaaaaacttttgttttttctcaagatgaatttccaaaagctaattctactgctgaagctttgggtgctttgagaccagcttttgataaagctggtactgttactgctggtaatgcttctggtattaatgatggtgctgctgctttggttattatggaagaatctgctgctttggctgctggtttgactccattggctagaattaaatcttatgcttctggtggtgttccaccagctttgatgggtatgggtccagttccagctactcaaaaagctttgcaattggctggtttgcaattggctgatattgatttgattgaagctaatgaagcttttgctgctcaatttttggctgttggtaaaaatttgggttttgattctgaaaaagttaatgttaatggtggtgctattgctttgggtcatccaattggtgcttctggtgctagaattttggttactttgttgcatgctatgcaagctagagataaaactttgggtttggctactttgtgtattggtggtggtcaaggtattgctatggttattgaaagattgaat

SEQ ID NO: 123 - DNA, 846 bp, Artificial Sequence
  codon optimized
atgaaaaaagtttgtgttattggtgctggtactatgggttctggtattgctcaagcttttgctgctaaaggttttgaagttgttttgagagatattaaagatgaatttgttgatagaggtttggattttattaataaaaatttgtctaaattggttaaaaaaggtaaaattgaagaagctactaaagttgaaattttgactagaatttctggtactgttgatttgaatatggctgctgattgtgatttggttattgaagctgctgttgaaagaatggatattaaaaaacaaatttttgctgatttggataatatttgtaaaccagaaactattttggcttctaatacttcttctttgtctattactgaagttgcttctgctactaaaagaccagataaagttattggtatgcatttttttaatccagctccagttatgaaattggttgaagttattagaggtattgctacttctcaagaaacttttgatgctgttaaagaaacttctattgctattggtaaagatccagttgaagttgctgaagctccaggttttgttgttaatagaattttgattccaatgattaatgaagctgttggtattttggctgaaggtattgcttctgttgaagatattgataaagctatgaaattgggtgctaatcatccaatgggtccattggaattgggtgattttattggtttggatatttgtttggctattatggatgttttgtattctgaaactggtgattctaaatatagaccacatactttgttgaaaaaatatgttagagctggttggttgggtagaaaatctggtaaaggtttttatgattattctaaa

SEQ ID NO: 124 - DNA, 783 bp, Artificial Sequence
  codon optimized
atggaattgaataatgttattttggaaaaagaaggtaaagttgctgttgttactattaatagaccaaaagctttgaatgctttgaattctgatactttgaaagaaatggattatgttattggtgaaattgaaaatgattctgaagttttggctgttattttgactggtgctggtgaaaaatcttttgttgctggtgctgatatttctgaaatgaaagaaatgaatactattgaaggtagaaaatttggtattttgggtaataaagtttttagaagattggaattgttggaaaaaccagttattgctgctgttaatggttttgctttgggtggtggttgtgaaattgctatgtcttgtgatattagaattgcttcttctaatgctagatttggtcaaccagaagttggtttgggtattactccaggttttggtggtactcaaagattgtctagattggttggtatgggtatggctaaacaattgatttttactgctcaaaatattaaagctgatgaagctttgagaattggtttggttaataaagttgttgaaccatctgaattgatgaatactgctaaagaaattgctaataaaattgtttctaatgctccagttgctgttaaattgtctaaacaagctattaatagaggtatgcaatgtgatattgatactgctttggcttttgaatctgaagcttttggtgaatgtttttctactgaagatcaaaaagatgctatgactgcttttattgaaaaaagaaaaattgaaggttttaaaaataga

SEQ ID NO: 125 - DNA, 1191 bp, Artificial Sequence
  codon optimized
atgattgttaaaccaatggttagaaataatatttgtttgaatgctcatccacaaggttgtaaaaaaggtgttgaagatcaaattgaatatactaaaaaaagaattactgctgaagttaaagctggtgctaaagctccaaaaaatgttttggttttgggttgttctaatggttatggtttggcttctagaattactgctgcttttggttatggtgctgctactattggtgtttcttttgaaaaagctggttctgaaactaaatatggtactccaggttggtataataatttggcttttgatgaagctgctaaaagagaaggtttgtattctgttactattgatggtgatgctttttctgatgaaattaaagctcaagttattgaagaagctaaaaaaaaaggtattaaatttgatttgattgtttattctttggcttctccagttagaactgatccagatactggtattatgcataaatctgttttgaaaccatttggtaaaacttttactggtaaaactgttgatccatttactggtgaattgaaagaaatttctgctgaaccagctaatgatgaagaagctgctgctactgttaaagttatgggtggtgaagattgggaaagatggattaaacaattgtctaaagaaggtttgttggaagaaggttgtattactttggcttattcttatattggtccagaagctactcaagctttgtatagaaaaggtactattggtaaagctaaagaacatttggaagctactgctcatagattgaataaagaaaatccatctattagagcttttgtttctgttaataaaggtttggttactagagcttctgctgttattccagttattccattgtatttggcttctttgtttaaagttatgaaagaaaaaggtaatcatgaaggttgtattgaacaaattactagattgtatgctgaaagattgtatagaaaagatggtactattccagttgatgaagaaaatagaattagaattgatgattgggaattggaagaagatgttcaaaaagctgtttctgctttgatggaaaaagttactggtgaaaatgctgaatctttgactgatttggctggttatagacatgattttttggcttctaatggttttgatgttgaaggtattaattatgaagctgaagttgaaagatttgatagaatt

SEQ ID NO: 126 - DNA, 1182 bp, Artificial Sequence
  codon optimized
atgactagagaagttgttgttgtttctggtgttagaactgctattggtacttttggtggttctttgaaagatgttgctccagctgaattgggtgctttggttgttagagaagctttggctagagctcaagtttctggtgatgatgttggtcatgttgtttttggtaatgttattcaaactgaaccaagagatatgtatttgggtagagttgctgctgttaatggtggtgttactattaatgctccagctttgactgttaatagattgtgtggttctggtttgcaagctattgtttctgctgctcaaactattttgttgggtgatactgatgttgctattggtggtggtgctgaatctatgtctagagctccatatttggctccagctgctagatggggtgctagaatgggtgatgctggtttggttgatatgatgttgggtgctttgcatgatccatttcatagaattcatatgggtgttactgctgaaaatgttgctaaagaatatgatatttctagagctcaacaagatgaagctgctttggaatctcatagaagagcttctgctgctattaaagctggttattttaaagatcaaattgttccagttgtttctaaaggtagaaaaggtgatgttacttttgatactgatgaacatgttagacatgatgctactattgatgatatgactaaattgagaccagtttttgttaaagaaaatggtactgttactgctggtaatgcttctggtttgaatgatgctgctgctgctgttgttatgatggaaagagctgaagctgaaagaagaggtttgaaaccattggctagattggtttcttatggtcatgctggtgttgatccaaaagctatgggtattggtccagttccagctactaaaattgctttggaaagagctggtttgcaagtttctgatttggatgttattgaagctaatgaagcttttgctgctcaagcttgtgctgttactaaagctttgggtttggatccagctaaagttaatccaaatggttctggtatttctttgggtcatccaattggtgctactggtgctttgattactgttaaagctttgcatgaattgaatagagttcaaggtagatatgctttggttactatgtgtattggtggtggtcaaggtattgctgctatttttgaaagaatt

SEQ ID NO: 127 - DNA, 1476 bp, Artificial Sequence
  codon optimized
atgaaactctcaactaaactttgttggtgtggtattaaaggaagacttaggccgcaaaagcaacaacaattacacaatacaaacttgcaaatgactgaactaaaaaaacaaaagaccgctgaacaaaaaaccagacctcaaaatgtcggtattaaaggtatccaaatttacatcccaactcaatgtgtcaaccaatctgagctagagaaatttgatggcgtttctcaaggtaaatacacaattggtctgggccaaaccaacatgtcttttgtcaatgacagagaagatatctactcgatgtccctaactgttttgtctaagttgatcaagagttacaacatcgacaccaacaaaattggtagattagaagtcggtactgaaactctgattgacaagtccaagtctgtcaagtctgtcttgatgcaattgtttggtgaaaacactgacgtcgaaggtattgacacgcttaatgcctgttacggtggtaccaacgcgttgttcaactctttgaactggattgaatctaacgcatgggatggtagagacgccattgtagtttgcggtgatattgccatctacgataagggtgccgcaagaccaaccggtggtgccggtactgttgctatgtggatcggtcctgatgctccaattgtatttgactctgtaagagcttcttacatggaacacgcctacgatttttacaagccagatttcaccagcgaatatccttacgtcgatggtcatttttcattaacttgttacgtcaaggctcttgatcaagtttacaagagttattccaagaaggctatttctaaagggttggttagcgatcccgctggttcggatgctttgaacgttttgaaatatttcgactacaacgttttccatgttccaacctgtaaattggtcacaaaatcatacggtagattactatataacgatttcagagccaatcctcaattgttcccagaagttgacgccgaattagctactcgcgattatgacgaatctttaaccgataagaacattgaaaaaacttttgttaatgttgctaagccattccacaaagagagagttgcccaatctttgattgttccaacaaacacaggtaacatgtacaccgcatctgtttatgccgcctttgcatctctattaaactatgttggatctgacgacttacaaggcaagcgtgttggtttattttcttacggttccggtttagctgcatctctatattcttgcaaaattgttggtgacgtccaacatattatcaaggaattagatattactaacaaattagccaagagaatcaccgaaactccaaaggattacgaagctgccatcgaattgagagaaaatgcccatttgaagaagaacttcaaacctcaaggttccattgagcatttgcaaagtggtgtttactacttgaccaacatcgatgacaaatttagaagatcttacgatgttaaaaaataa

SEQ ID NO: 128 - DNA, 1143 bp, Artificial Sequence
  codon optimized
atggttgcggtacgtaggaaggctctttcaattttggcagaagctcctgtattagcatctgatcgtttaccatataaaaattatgactacgaccgcgtatttggcgcttgttgtgaaaatgttataggttacatgcctttgcccgttggtgttataggccccttggttatcgatggtacatcttatcatataccaatggcaactacagagggttgtttggtagcttctgccatgcgtggctgtaaggcaatcaatgctggcggtggtgcaacaactgttttaactaaggatggtatgacaagaggcccagtagtccgtttcccaactttgaaaagatctggtgcctgtaagatatggttagactcagaagagggacaaaacgcaattaaaaaagcttttaactctacatcaagatttgcacgtctgcaacatattcaaacttgtctagcaggagatttactcttcatgagatttagaacaactactggtgacgcaatgggtatgaatatgatttctaaaggtgtcgaatactcattaaagcaaatggtagaagagtatggctgggaagatatggaggttgtctccgtttctggtaactactgtaccgacaaaaaaccagctgccatcaactggatcgaaggtcgtggtaagagtgtcgtcgcagaagctactattcctggtgatgttgtcagaaaagtgttaaaaagtgatgtttccgcattggttgagttgaacattgctaagaatttggttggatctgcaatggctgggtctgttggtggatttaacgcacatgcagctaatttagtgacagctgttttcttggcattaggacaagatcctgcacaaaatgttgaaagttccaactgtataacattgatgaaagaagtggacggtgatttgagaatttccgtatccatgccatccatcgaagtaggtaccatcggtggtggtactgttctagaaccacaaggtgccatgttggacttattaggtgtaagaggcccgcatgctaccgctcctggtaccaacgcacgtcaattagcaagaatagttgcctgtgccgtcttggcaggtgaattatccttatgtgctgccctagcagccggccatttggttcaaagtcatatgacccacaacagg

SEQ ID NO: 129 - DNA, 1332 bp, Artificial Sequence
  codon optimized
atgtcattaccgttcttaacttctgcaccgggaaaggttattatttttggtgaacactctgctgtgtacaacaagcctgccgtcgctgctagtgtgtctgcgttgagaacctacctgctaataagcgagtcatctgcaccagatactattgaattggacttcccggacattagctttaatcataagtggtccatcaatgatttcaatgccatcaccgaggatcaagtaaactcccaaaaattggccaaggctcaacaagccaccgatggcttgtctcaggaactcgttagtcttttggatccgttgttagctcaactatccgaatccttccactaccatgcagcgttttgtttcctgtatatgtttgtttgcctatgcccccatgccaagaatattaagttttctttaaagtctactttacccatcggtgctgggttgggctcaagcgcctctatttctgtatcactggccttagctatggcctacttgggggggttaataggatctaatgacttggaaaagctgtcagaaaacgataagcatatagtgaatcaatgggccttcataggtgaaaagtgtattcacggtaccccttcaggaatagataacgctgtggccacttatggtaatgccctgctatttgaaaaagactcacataatggaacaataaacacaaacaattttaagttcttagatgatttcccagccattccaatgatcctaacctatactagaattccaaggtctacaaaagatcttgttgctcgcgttcgtgtgttggtcaccgagaaatttcctgaagttatgaagccaattctagatgccatgggtgaatgtgccctacaaggcttagagatcatgactaagttaagtaaatgtaaaggcaccgatgacgaggctgtagaaactaataatgaactgtatgaacaactattggaattgataagaataaatcatggactgcttgtctcaatcggtgtttctcatcctggattagaacttattaaaaatctgagcgatgatttgagaattggctccacaaaacttaccggtgctggtggcggcggttgctctttgactttgttacgaagagacattactcaagagcaaattgacagcttcaaaaagaaattgcaagatgattttagttacgagacatttgaaacagacttgggtgggactggctgctgtttgttaagcgcaaaaaatttgaataaagatcttaaaatcaaatccctagtattccaattatttgaaaataaaactaccacaaagcaacaaattgacgatctattattgccaggaaacacgaatttaccatggacttcataa

SEQ ID NO: 130 - DNA, 1356 bp, Artificial Sequence
  codon optimized
atgtcagagttgagagccttcagtgccccagggaaagcgttactagctggtggatatttagttttagatacaaaatatgaagcatttgtagtcggattatcggcaagaatgcatgctgtagcccatccttacggttcattgcaagggtctgataagtttgaagtgcgtgtgaaaagtaaacaatttaaagatggggagtggctgtaccatataagtcctaaaagtggcttcattcctgtttcgataggcggatctaagaaccctttcattgaaaaagttatcgctaacgtatttagctactttaaacctaacatggacgactactgcaatagaaacttgttcgttattgatattttctctgatgatgcctaccattctcaggaggatagcgttaccgaacatcgtggcaacagaagattgagttttcattcgcacagaattgaagaagttcccaaaacagggctgggctcctcggcaggtttagtcacagttttaactacagctttggcctccttttttgtatcggacctggaaaataatgtagacaaatatagagaagttattcataatttagcacaagttgctcattgtcaagctcagggtaaaattggaagcgggtttgatgtagcggcggcagcatatggatctatcagatatagaagattcccacccgcattaatctctaatttgccagatattggaagtgctacttacggcagtaaactggcgcatttggttgatgaagaagactggaatattacgattaaaagtaaccatttaccttcgggattaactttatggatgggcgatattaagaatggttcagaaacagtaaaactggtccagaaggtaaaaaattggtatgattcgcatatgccagaaagcttgaaaatatatacagaactcgatcatgcaaattctagatttatggatggactatctaaactagatcgcttacacgagactcatgacgattacagcgatcagatatttgagtctcttgagaggaatgactgtacctgtcaaaagtatcctgaaatcacagaagttagagatgcagttgccacaattagacgttcctttagaaaaataactaaagaatctggtgccgatatcgaacctcccgtacaaactagcttattggatgattgccagaccttaaaaggagttcttacttgcttaatacctggtgctggtggttatgacgccattgcagtgattactaagcaagatgttgatcttagggctcaaaccgctaatgacaaaagattttctaaggttcaatggctggatgtaactcaggctgactggggtgttaggaaagaaaaagatccggaaacttatcttgataaataa

SEQ ID NO: 131 - DNA, 1191 bp, Artificial Sequence
  codon optimized
atgaccgtttacacagcatccgttaccgcacccgtcaacatcgcaacccttaagtattgggggaaaagggacacgaagttgaatctgcccaccaattcgtccatatcagtgactttatcgcaagatgacctcagaacgttgacctctgcggctactgcacctgagtttgaacgcgacactttgtggttaaatggagaaccacacagcatcgacaatgaaagaactcaaaattgtctgcgcgacctacgccaattaagaaaggaaatggaatcgaaggacgcctcattgcccacattatctcaatggaaactccacattgtctccgaaaataactttcctacagcagctggtttagcttcctccgctgctggctttgctgcattggtctctgcaattgctaagttataccaattaccacagtcaacttcagaaatatctagaatagcaagaaaggggtctggttcagcttgtagatcgttgtttggcggatacgtggcctgggaaatgggaaaagctgaagatggtcatgattccatggcagtacaaatcgcagacagctctgactggcctcagatgaaagcttgtgtcctagttgtcagcgatattaaaaaggatgtgagttccactcagggtatgcaattgaccgtggcaacctccgaactatttaaagaaagaattgaacatgtcgtaccaaagagatttgaagtcatgcgtaaagccattgttgaaaaagatttcgccacctttgcaaaggaaacaatgatggattccaactctttccatgccacatgtttggactctttccctccaatattctacatgaatgacacttccaagcgtatcatcagttggtgccacaccattaatcagttttacggagaaacaatcgttgcatacacgtttgatgcaggtccaaatgctgtgttgtactacttagctgaaaatgagtcgaaactctttgcatttatctataaattgtttggctctgttcctggatgggacaagaaatttactactgagcagcttgaggctttcaaccatcaatttgaatcatctaactttactgcacgtgaattggatcttgagttgcaaaaggatgttgccagagtgattttaactcaagtcggttcaggcccacaagaaacaaacgaatctttgattgacgcaaagactggtctaccaaaggaataa

SEQ ID NO: 132 - DNA, 867 bp, Artificial Sequence
  codon optimized
atgactgccgacaacaatagtatgccccatggtgcagtatctagttacgccaaattagtgcaaaaccaaacacctgaagacattttggaagagtttcctgaaattattccattacaacaaagacctaatacccgatctagtgagacgtcaaatgacgaaagcggagaaacatgtttttctggtcatgatgaggagcaaattaagttaatgaatgaaaattgtattgttttggattgggacgataatgctattggtgccggtaccaagaaagtttgtcatttaatggaaaatattgaaaagggtttactacatcgtgcattctccgtctttattttcaatgaacaaggtgaattacttttacaacaaagagccactgaaaaaataactttccctgatctttggactaacacatgctgctctcatccactatgtattgatgacgaattaggtttgaagggtaagctagacgataagattaagggcgctattactgcggcggtgagaaaactagatcatgaattaggtattccagaagatgaaactaagacaaggggtaagtttcactttttaaacagaatccattacatggcaccaagcaatgaaccatggggtgaacatgaaattgattacatcctattttataagatcaacgctaaagaaaacttgactgtcaacccaaacgtcaatgaagttagagacttcaaatgggtttcaccaaatgatttgaaaactatgtttgctgacccaagttacaagtttacgccttggtttaagattatttgcgagaattacttattcaactggtgggagcaattagatgacctttctgaagtggaaaatgacaggcaaattcatagaatgctataa

SEQ ID NO: 133 - DNA, 1059 bp, Artificial Sequence
  codon optimized
atggcttcagaaaaggaaataagaagagaaagattcttgaacgtattcccaaagttagttgaagaattgaacgctagtttgttagcttatggtatgcctaaagaagcctgcgattggtatgctcactctttaaactacaatactccaggtggtaaattgaatagaggtttgagtgtagttgatacttatgctatcttgtctaacaaaaccgttgaacaattaggtcaagaagaatacgaaaaggtcgctatcttgggttggtgtattgaattgttgcaagcatactttttggttgccgatgacatgatggataagtctataacaagaagaggtcaaccatgctggtacaaagttccagaagttggtgaaatagccataaatgatgcttttatgttggaagccgctatctataaattgttgaagtcacatttcagaaacgaaaagtactacatcgatattaccgaattattccacgaagttactttccaaacagaattgggtcaattgatggatttgataactgcacctgaagataaagttgacttgtcaaagttttccttgaagaaacattcattcatcgtcacctttgaaactgcttattactccttctatttgccagtcgccttggctatgtacgtagctggtattactgatgaaaaagacttgaagcaagcaagagatgttttgatacctttgggtgaatacttccaaatccaagatgactacttagactgtttcggtactccagaacaaataggtaaaatcggtacagatattcaagacaataagtgcagttgggttattaacaaggctttggaattagcatctgccgaacaaagaaagactttggatgaaaactacggtaaaaaggactcagttgctgaagcaaagtgtaagaaaatttttaatgatttgaagattgaacaattgtaccatgaatacgaagaatccatcgctaaagacttaaaggcaaagattagtcaagttgatgaatcaagaggttttaaagccgacgttttgacagctttcttgaataaggtctacaagagatcaaagtag

SEQ ID NO: 134 - DNA, 1155 bp, Artificial Sequence
  codon optimized
atgaatcatttgagagctgaaggtccagcttctgttttggctattggtactgctaatccagaaaatattttgttgcaagatgaatttccagattattattttagagttactaaatctgaacatatgactcaattgaaagaaaaatttagaaaaatttgtgataaatctatgattagaaaaagaaattgttttttgaatgaagaacatttgaaacaaaatccaagattggttgaacatgaaatgcaaactttggatgctagacaagatatgttggttgttgaagttccaaaattgggtaaagatgcttgtgctaaagctattaaagaatggggtcaaccaaaatctaaaattactcatttgatttttacttctgcttctactactgatatgccaggtgctgattatcattgtgctaaattgttgggtttgtctccatctgttaaaagagttatgatgtatcaattgggttgttatggtggtggtactgttttgagaattgctaaagatattgctgaaaataataaaggtgctagagttttggctgtttgttgtgatattatggcttgtttgtttagaggtccatctgaatctgatttggaattgttggttggtcaagctatttttggtgatggtgctgctgctgttattgttggtgctgaaccagatgaatctgttggtgaaagaccaatttttgaattggtttctactggtcaaactattttgccaaattctgaaggtactattggtggtcatattagagaagctggtttgatttttgatttgcataaagatgttccaatgttgatttctaataatattgaaaaatgtttgattgaagcttttactccaattggtatttctgattggaattctattttttggattactcatccaggtggtaaagctattttggataaagttgaagaaaaattgcatttgaaatctgataaatttgttgattctagacatgttttgtctgaacatggtaatatgtcttcttctactgttttgtttgttatggatgaattgagaaaaagatctttggaagaaggtaaatctactactggtgatggttttgaatggggtgttttgtttggttttggtccaggtttgactgttgaaagagttgttgttagatctgttccaattaaatat

SEQ ID NO: 135 - DNA, 303 bp, Artificial Sequence
  codon optimized
atggctgttaaacatttgattgttttgaaatttaaagatgaaattactgaagctcaaaaagaagaattttttaaaacttatgttaatttggttaatattattccagctatgaaagatgtttattggggtaaagatgttactcaaaaaaataaagaagaaggttatactcatattgttgaagttacttttgaatctgttgaaactattcaagattatattattcatccagctcatgttggttttggtgatgtttatagatctttttgggaaaaattgttgatttttgattatactccaagaaaa

SEQ ID NO: 136 - DNA, 1185 bp, Artificial Sequence
  codon optimized
atgggtttgtcttctgtttgtactttttcttttcaaactaattatcatactttgttgaatccacataataataatccaaaaacttctttgttgtgttatagacatccaaaaactccaattaaatattcttataataattttccatctaaacattgttctactaaatcttttcatttgcaaaataaatgttctgaatctttgtctattgctaaaaattctattagagctgctactactaatcaaactgaaccaccagaatctgataatcattctgttgctactaaaattttgaattttggtaaagcttgttggaaattgcaaagaccatatactattattgcttttacttcttgtgcttgtggtttgtttggtaaagaattgttgcataatactaatttgatttcttggtctttgatgtttaaagcttttttttttttggttgctattttgtgtattgcttcttttactactactattaatcaaatttatgatttgcatattgatagaattaataaaccagatttgccattggcttctggtgaaatttctgttaatactgcttggattatgtctattattgttgctttgtttggtttgattattactattaaaatgaaaggtggtccattgtatatttttggttattgttttggtatttttggtggtattgtttattctgttccaccatttagatggaaacaaaatccatctactgcttttttgttgaattttttggctcatattattactaattttactttttattatgcttctagagctgctttgggtttgccatttgaattgagaccatcttttacttttttgttggcttttatgaaatctatgggttctgctttggctttgattaaagatgcttctgatgttgaaggtgatactaaatttggtatttctactttggcttctaaatatggttctagaaatttgactttgttttgttctggtattgttttgttgtcttatgttgctgctattttggctggtattatttggccacaagcttttaattctaatgttatgttgttgtctcatgctattttggctttttggttgattttgcaaactagagattttgctttgactaattatgatccagaagctggtagaagattttatgaatttatgtggaaattgtattatgctgaatatttggtttatgtttttatt

SEQ ID NO: 137 - DNA, 6702 bp, Artificial Sequence
  codon optimized
atgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataatggtattgccgccgtgaaagaaattagatccgtcagaaaatgggcatacgagacgttcggcgatgacagaaccgtccaattcgtcgccatggccaccccagaagatctggaggccaacgcagaatatatccgtatggccgatcaatacattgaagtgccaggtggtactaataataacaactacgctaacgtagacttgatcgtagacatcgccgaaagagcagacgtagacgccgtatgggctggctggggtcacgcctccgagaatccactattgcctgaaaaattgtcccagtctaagaggaaagtcatctttattgggcctccaggtaacgccatgaggtctttaggtgataaaatctcctctaccattgtcgctcaaagtgctaaagtcccatgtattccatggtctggtaccggtgttgacaccgttcacgtggacgagaaaaccggtctggtctctgtcgacgatgacatctatcaaaagggttgttgtacctctcctgaagatggtttacaaaaggccaagcgtattggttttcctgtcatgattaaggcatccgaaggtggtggtggtaaaggtatcagacaagttgaacgtgaagaagatttcatcgctttataccaccaggcagccaacgaaattccaggctcccccattttcatcatgaagttggccggtagagcgcgtcacttggaagttcaactgctagcagatcagtacggtacaaatatttccttgttcggtagagactgttccgttcagagacgtcatcaaaaaattatcgaagaagcaccagttacaattgccaaggctgaaacatttcacgagatggaaaaggctgccgtcagactggggaaactagtcggttatgtctctgccggtaccgtggagtatctatattctcatgatgatggaaaattctactttttagaattgaacccaagattacaagtcgagcatccaacaacggaaatggtctccggtgttaacttacctgcagctcaattacaaatcgctatgggtatccctatgcatagaataagtgacattagaactttatatggtatgaatcctcattctgcctcagaaatcgatttcgaattcaaaactcaagatgccaccaagaaacaaagaagacctattccaaagggtcattgtaccgcttgtcgtatcacatcagaagatccaaacgatggattcaagccatcgggtggtactttgcatgaactaaacttccgttcttcctctaatgtttggggttacttctccgtgggtaacaatggtaatattcactccttttcggactctcagttcggccatatttttgcttttggtgaaaatagacaagcttccaggaaacacatggttgttgccctgaaggaattgtccattaggggtgatttcagaactactgtggaatacttgatcaaacttttggaaactgaagatttcgaggataacactattaccaccggttggttggacgatttgattactcataaaatgaccgctgaaaagcctgatccaactcttgccgtcatttgcggtgccgctacaaaggctttcttagcatctgaagaagcccgccacaagtatatcgaatccttacaaaagggacaagttctatctaaagacctactgcaaactatgttccctgtagattttatccatgagggtaaaagatacaagttcaccgtagctaaatccggtaatgaccgttacacattatttatcaatggttctaaatgtgatatcatactgcgtcaactatctgatggtggtcttttgattgccataggcggtaaatcgcataccatctattggaaagaagaagttgctgctacaagattatccgttgactctatgactactttgttggaagttgaaaacgatccaacccagttgcgtactccatcccctggtaaattggttaaattcttggtggaaaatggtgaacacattatcaagggccaaccatatgcagaaattgaagttatgaaaatgcaaatgcctttggtttctcaagaaaatggtatcgtccagttattaaagcaacctggttctaccattgttgcaggtgatatcatggctattatgactcttgacgatccatccaaggtcaagcacgctctaccatttgaaggtatgctgccagattttggttctccagttatcgaaggaaccaaacctgcctataaattcaagtcattagtgtctactttggaaaacattttgaagggttatgacaaccaagttattatgaacgcttccttgcaacaattgatagaggttttgagaaatccaaaactgccttactcagaatggaaactacacatctctgctttacattcaagattgcctgctaagctagatgaacaaatggaagagttagttgcacgttctttgagacgtggtgctgttttcccagctagacaattaagtaaattgattgatatggccgtgaagaatcctgaatacaaccccgacaaattgctgggcgccgtcgtggaaccattggcggatattgctcataagtactctaacgggttagaagcccatgaacattctatatttgtccatttcttggaagaatattacgaagttgaaaagttattcaatggtccaaatgttcgtgaggaaaatatcattctgaaattgcgtgatgaaaaccctaaagatctagataaagttgcgctaactgttttgtctcattcgaaagtttcagcgaagaataacctgatcctagctatcttgaaacattatcaaccattgtgcaagttatcttctaaagtttctgccattttctctactcctctacaacatattgttgaactagaatctaaggctaccgctaaggtcgctctacaagcaagagaaattttgattcaaggcgctttaccttcggtcaaggaaagaactgaacaaattgaacatatcttaaaatcctctgttgtgaaggttgcctatggctcatccaatccaaagcgctctgaaccagatttgaatatcttgaaggacttgatcgattctaattacgttgtgttcgatgttttacttcaattcctaacccatcaagacccagttgtgactgctgcagctgctcaagtctatattcgtcgtgcttatcgtgcttacaccataggagatattagagttcacgaaggtgtcacagttccaattgttgaatggaaattccaactaccttcagctgcgttctccacctttccaactgttaaatctaaaatgggtatgaacagggctgtttctgtttcagatttgtcatatgttgcaaacagtcagtcatctccgttaagagaaggtattttgatggctgtggatcatttagatgatgttgatgaaattttgtcacaaagtttggaagttattcctcgtcaccaatcttcttctaacggacctgctcctgatcgttctggtagctccgcatcgttgagtaatgttgctaatgtttgtgttgcttctacagaaggtttcgaatctgaagaggaaattttggtaaggttgagagaaattttggatttgaataagcaggaattaatcaatgcttctatccgtcgtatcacatttatgttcggttttaaagatgggtcttatccaaagtattatacttttaacggtccaaattataacgaaaatgaaacaattcgtcacattgagccggctttggccttccaactggaattaggaagattgtccaacttcaacattaaaccaattttcactgataatagaaacatccatgtctacgaagctgttagtaagacttctccattggataagagattctttacaagaggtattattagaacgggtcatatccgtgatgacatttctattcaagaatatctgacttctgaagctaacagattgatgagtgatatattggataatttagaagtcaccgacacttcaaattctgatttgaatcatatcttcatcaacttcattgcggtgtttgatatctctccagaagatgtcgaagccgccttcggtggtttcttagaaagatttggtaagagattgttgagattgcgtgtttcttctgccgaaattagaatcatcatcaaagatcctcaaacaggtgccccagtaccattgcgtgccttgatcaataacgtttctggttatgttatcaaaacagaaatgtacaccgaagtcaagaacgcaaaaggtgaatgggtatttaagtctttgggtaaacctggatccatgcatttaagacctattgctactccttaccctgttaaggaatggttgcaaccaaaacgttataaggcacacttgatgggtaccacatatgtctatgacttcccagaattattccgccaagcatcgtcatcccaatggaaaaatttctctgcagatgttaagttaacagatgatttctttatttccaacgagttgattgaagatgaaaacggcgaattaactgaggtggaaagagaacctggtgccaacgctattggtatggttgcctttaagattactgtaaagactcctgaatatccaagaggccgtcaatttgttgttgttgctaacgatatcacattcaagatcggttcctttggtccacaagaagacgaattcttcaataaggttactgaatatgctagaaagcgtggtatcccaagaatttacttggctgcaaactcaggtgccagaattggtatggctgaagagattgttccactatttcaagttgcatggaatgatgctgccaatccggacaagggcttccaatacttatacttaacaagtgaaggtatggaaactttaaagaaatttgacaaagaaaattctgttctcactgaacgtactgttataaacggtgaagaaagatttgtcatcaagacaattattggttctgaagatgggttaggtgtcgaatgtctacgtggatctggtttaattgctggtgcaacgtcaagggcttaccacgatatcttcactatcaccttagtcacttgtagatccgtcggtatcggtgcttatttggttcgtttgggtcaaagagctattcaggtcgaaggccagccaattattttaactggtgctcctgcaatcaacaaaatgctgggtagagaagtttatacttctaacttacaattgggtggtactcaaatcatgtataacaacggtgtttcacatttgactgctgttgacgatttagctggtgtagagaagattgttgaatggatgtcttatgttccagccaagcgtaatatgccagttcctatcttggaaactaaagacacatgggatagaccagttgatttcactccaactaatgatgaaacttacgatgtaagatggatgattgaaggtcgtgagactgaaagtggatttgaatatggtttgtttgataaagggtctttctttgaaactttgtcaggatgggccaaaggtgttgtcgttggtagagcccgtcttggtggtattccactgggtgttattggtgttgaaacaagaactgtcgagaacttgattcctgctgatccagctaatccaaatagtgctgaaacattaattcaagaacctggtcaagtttggcatccaaactccgccttcaagactgctcaagctatcaatgactttaacaacggtgaacaattgccaatgatgattttggccaactggagaggtttctctggtggtcaacgtgatatgttcaacgaagtcttgaagtatggttcgtttattgttgacgcattggtggattacaaacaaccaattattatctatatcccacctaccggtgaactaagaggtggttcatgggttgttgtcgatccaactatcaacgctgaccaaatggaaatgtatgccgacgtcaacgctagagctggtgttttggaaccacaaggtatggttggtatcaagttccgtagagaaaaattgctggacaccatgaacagattggatgacaagtacagagaattgagatctcaattatccaacaagagtttggctccagaagtacatcagcaaatatccaagcaattagctgatcgtgagagagaactattgccaatttacggacaaatcagtcttcaatttgctgatttgcacgataggtcttcacgtatggtggccaagggtgttatttctaaggaactggaatggaccgaggcacgtcgtttcttcttctggagattgagaagaagattgaacgaagaatatttgattaaaaggttgagccatcaggtaggcgaagcatcaagattagaaaagatcgcaagaattagatcgtggtaccctgcttcagtggaccatgaagatgataggcaagtcgcaacatggattgaagaaaactacaaaactttggacgataaactaaagggtttgaaattagagtcattcgctcaagacttagctaaaaagatcagaagcgaccatgacaatgctattgatggattatctgaagttatcaagatgttatctaccgatgataaagaaaaattgttgaagactttgaaataa

SEQ ID NO: 138 - DNA, 1632 bp, Artificial Sequence
  codon optimized
atgaaatgttctactttttctttttggtttgtttgtaaaattatttttttttttttttcttttaatattcaaacttctattgctaatccaagagaaaattttttgaaatgtttttctcaatatattccaaataatgctactaatttgaaattggtttatactcaaaataatccattgtatatgtctgttttgaattctactattcataatttgagatttacttctgatactactccaaaaccattggttattgttactccatctcatgtttctcatattcaaggtactattttgtgttctaaaaaagttggtttgcaaattagaactagatctggtggtcatgattctgaaggtatgtcttatatttctcaagttccatttgttattgttgatttgagaaatatgagatctattaaaattgatgttcattctcaaactgcttgggttgaagctggtgctactttgggtgaagtttattattgggttaatgaaaaaaatgaaaatttgtctttggctgctggttattgtccaactgtttgtgctggtggtcattttggtggtggtggttatggtccattgatgagaaattatggtttggctgctgataatattattgatgctcatttggttaatgttcatggtaaagttttggatagaaaatctatgggtgaagatttgttttgggctttgagaggtggtggtgctgaatcttttggtattattgttgcttggaaaattagattggttgctgttccaaaatctactatgttttctgttaaaaaaattatggaaattcatgaattggttaaattggttaataaatggcaaaatattgcttataaatatgataaagatttgttgttgatgactcattttattactagaaatattactgataatcaaggtaaaaataaaactgctattcatacttatttttcttctgtttttttgggtggtgttgattctttggttgatttgatgaataaatcttttccagaattgggtattaaaaaaactgattgtagacaattgtcttggattgatactattattttttattctggtgttgttaattatgatactgataattttaataaagaaattttgttggatagatctgctggtcaaaatggtgcttttaaaattaaattggattatgttaaaaaaccaattccagaatctgtttttgttcaaattttggaaaaattgtatgaagaagatattggtgctggtatgtatgctttgtatccatatggtggtattatggatgaaatttctgaatctgctattccatttccacatagagctggtattttgtatgaattgtggtatatttgttcttgggaaaaacaagaagataatgaaaaacatttgaattggattagaaatatttataattttatgactccatatgtttctaaaaatccaagattggcttatttgaattatagagatttggatattggtattaatgatccaaaaaatccaaataattatactcaagctagaatttggggtgaaaaatattttggtaaaaattttgatagattggttaaagttaaaactttggttgatccaaataatttttttagaaatgaacaatctattccaccattgccaagacatagacat

SEQ ID NO: 139 - DNA, 1635 bp, Artificial Sequence
  codon optimized
atgaattgtagtactttctctttctggtttgtttgtaagattatatttttttttcttagtttcaatatacaaatttcaattgcaaaccctcaagaaaatttccttaagtgcttttcagaatatatccctaataatcctgcaaaccctaaattcatttatacacaacatgatcagttatatatgtctgtcttaaactctaccattcaaaatttgaggttcacgtctgatacaaccccaaagcctttagttatcgtgacaccctctaacgttagtcatattcaggctagtatcttatgttcaaaaaaagtgggtttacaaatcagaactaggtctggtggtcatgacgcggaaggtctgtcttacatatctcaggtgccgtttgcaatcgttgatctacgtaatatgcatacagttaaagtcgatattcactctcaaactgcatgggtcgaggctggtgccactctaggtgaagtttattactggatcaatgaaatgaacgagaatttttccttcccaggtggttattgtcctactgtgggtgtaggcggacacttttctggcggggggtatggtgctttgatgaggaactatggtttggccgccgataatataattgacgcccatcttgtaaacgtcgacgggaaggttctggaccgtaaatctatgggtgaagatttattctgggcgataagaggtggcgggggagagaactttggtattatcgcagcttgtaagattaagttagttgttgtcccctcaaaagcaacaattttttcagtgaagaagaacatggaaatccacggtttggtaaaactgtttaataaatggcagaatattgcctacaaatacgataaggatttgatgttgacaacacatttcagaactagaaatattactgacaaccacggaaagaacaagacaaccgtccatggatattttagttctattttcttaggcggagttgattcactagtagacttaatgaacaagtctttccccgaattgggaataaaaaaaaccgattgcaaggaattatcctggatagatacaacaatattctactctggagtcgttaattataatacggccaactttaagaaggaaatattattagatcgttccgcaggtaaaaagacagctttttccataaaattggactacgtcaaaaaattaattcctgagacagccatggtaaaaatattggaaaaattgtacgaagaggaggtaggcgtgggtatgtatgtgttatacccatacggtggtattatggatgaaatttctgagagcgctattcccttcccccatcgtgcaggtataatgtatgaattatggtacacagcaacatgggaaaaacaagaggataacgaaaagcatattaattgggtacgtagtgtgtacaactttacgacaccttacgtgtcccaaaatccaagattagcgtatttgaactatagagacttagatttaggtaaaacaaaccctgagtctccaaataattacacccaagccaggatttggggtgaaaaatacttcggcaaaaatttcaatagattggttaaggtaaaaactaaggcggatccaaacaatttttttagaaatgagcagagtattccgcccctgcctccaagacaccat

SEQ ID NO: 140 - DNA, 2160 bp, Artificial Sequence
  codon optimized
atgggtaaaaattataaatctttggattctgttgttgcttctgattttattgctttgggtattacttctgaagttgctgaaactttgcatggtagattggctgaaattgtttgtaattatggtgctgctactccacaaacttggattaatattgctaatcatattttgtctccagatttgccattttctttgcatcaaatgttgttttatggttgttataaagattttggtccagctccaccagcttggattccagatccagaaaaagttaaatctactaatttgggtgctttgttggaaaaaagaggtaaagaatttttgggtgttaaatataaagatccaatttcttctttttctcattttcaagaattttctgttagaaatccagaagtttattggagaactgttttgatggatgaaatgaaaatttctttttctaaagatccagaatgtattttgagaagagatgatattaataatccaggtggttctgaatggttgccaggtggttatttgaattctgctaaaaattgtttgaatgttaattctaataaaaaattgaatgatactatgattgtttggagagatgaaggtaatgatgatttgccattgaataaattgactttggatcaattgagaaaaagagtttggttggttggttatgctttggaagaaatgggtttggaaaaaggttgtgctattgctattgatatgccaatgcatgttgatgctgttgttatttatttggctattgttttggctggttatgttgttgtttctattgctgattctttttctgctccagaaatttctactagattgagattgtctaaagctaaagctatttttactcaagatcatattattagaggtaaaaaaagaattccattgtattctagagttgttgaagctaaatctccaatggctattgttattccatgttctggttctaatattggtgctgaattgagagatggtgatatttcttgggattattttttggaaagagctaaagaatttaaaaattgtgaatttactgctagagaacaaccagttgatgcttatactaatattttgttttcttctggtactactggtgaaccaaaagctattccatggactcaagctactccattgaaagctgctgctgatggttggtctcatttggatattagaaaaggtgatgttattgtttggccaactaatttgggttggatgatgggtccatggttggtttatgcttctttgttgaatggtgcttctattgctttgtataatggttctccattggtttctggttttgctaaatttgttcaagatgctaaagttactatgttgggtgttgttccatctattgttagatcttggaaatctactaattgtgtttctggttatgattggtctactattagatgtttttcttcttctggtgaagcttctaatgttgatgaatatttgtggttgatgggtagagctaattataaaccagttattgaaatgtgtggtggtactgaaattggtggtgctttttctgctggttcttttttgcaagctcaatctttgtcttctttttcttctcaatgtatgggttgtactttgtatattttggataaaaatggttatccaatgccaaaaaataaaccaggtattggtgaattggctttgggtccagttatgtttggtgcttctaaaactttgttgaatggtaatcatcatgatgtttattttaaaggtatgccaactttgaatggtgaagttttgagaagacatggtgatatttttgaattgacttctaatggttattatcatgctcatggtagagctgatgatactatgaatattggtggtattaaaatttcttctattgaaattgaaagagtttgtaatgaagttgatgatagagtttttgaaactactgctattggtgttccaccattgggtggtggtccagaacaattggttattttttttgttttgaaagattctaatgatactactattgatttgaatcaattgagattgtcttttaatttgggtttgcaaaaaaaattgaatccattgtttaaagttactagagttgttccattgtcttctttgccaagaactgctactaataaaattatgagaagagttttgagacaacaattttctcattttgaa

SEQ ID NO: 141 - DNA, 4587 bp, Artificial Sequence
  codon optimized
atgtctgctaaagctatttctgaacaaactggtaaagaattgttgtataaatttatttgtactacttctgctattcaaaatagatttaaatatgctagagttactccagatactgattgggctagattgttgcaagatcatccatggttgttgtctcaaaatttggttgttaaaccagatcaattgattaaaagaagaggtaaattgggtttggttggtgttaatttgactttggatggtgttaaatcttggttgaaaccaagattgggtcaagaagctactgttggtaaagctactggttttttgaaaaattttttgattgaaccatttgttccacattctcaagctgaagaattttatgtttgtatttatgctactagagaaggtgattatgttttgtttcatcatgaaggtggtgttgatgttggtgatgttgatgctaaagctcaaaaattgttggttggtgttgatgaaaaattgaatccagaagatattaaaaaacatttgttggttcatgctccagaagataaaaaagaaattttggcttcttttatttctggtttgtttaatttttatgaagatttgtattttacttatttggaaattaatccattggttgttactaaagatggtgtttatgttttggatttggctgctaaagttgatgctactgctgattatatttgtaaagttaaatggggtgatattgaatttccaccaccatttggtagagaagcttatccagaagaagcttatattgctgatttggatgctaaatctggtgcttctttgaaattgactttgttgaatccaaaaggtagaatttggactatggttgctggtggtggtgcttctgttgtttattctgatactatttgtgatttgggtggtgttaatgaattggctaattatggtgaatattctggtgctccatctgaacaacaaacttatgattatgctaaaactattttgtctttgatgactagagaaaaacatccagatggtaaaattttgattattggtggttctattgctaattttactaatgttgctgctacttttaaaggtattgttagagctattagagattatcaaggtccattgaaagaacatgaagttactatttttgttagaagaggtggtccaaattatcaagaaggtttgagagttatgggtgaagttggtaaaactactggtattccaattcatgtttttggtactgaaactcatatgactgctattgttggtatggctttgggtcatagaccaattccaaatcaaccaccaactgctgctcatactgctaattttttgttgaatgcttctggttctacttctactccagctccatctagaactgcttctttttctgaatctagagctgatgaagttgctccagctaaaaaagctaaaccagctatgccacaagattctgttccatctccaagatctttgcaaggtaaatctactactttgttttctagacatactaaagctattgtttggggtatgcaaactagagctgttcaaggtatgttggattttgattatgtttgttctagagatgaaccatctgttgctgctatggtttatccatttactggtgatcataaacaaaaattttattggggtcataaagaaattttgattccagtttttaaaaatatggctgatgctatgagaaaacatccagaagttgatgttttgattaattttgcttctttgagatctgcttatgattctactatggaaactatgaattatgctcaaattagaactattgctattattgctgaaggtattccagaagctttgactagaaaattgattaaaaaagctgatcaaaaaggtgttactattattggtccagctactgttggtggtattaaaccaggttgttttaaaattggtaatactggtggtatgttggataatattttggcttctaaattgtatagaccaggttctgttgcttatgtttctagatctggtggtatgtctaatgaattgaataatattatttctagaactactgatggtgtttatgaaggtgttgctattggtggtgatagatatccaggttctacttttatggatcatgttttgagatatcaagatactccaggtgttaaaatgattgttgttttgggtgaaattggtggtactgaagaatataaaatttgtagaggtattaaagaaggtagattgactaaaccaattgtttgttggtgtattggtacttgtgctactatgttttcttctgaagttcaatttggtcatgctggtgcttgtgctaatcaagcttctgaaactgctgttgctaaaaatcaagctttgaaagaagctggtgtttttgttccaagatcttttgatgaattgggtgaaattattcaatctgtttatgaagatttggttgctaatggtgttattgttccagctcaagaagttccaccaccaactgttccaatggattattcttgggctagagaattgggtttgattagaaaaccagcttcttttatgacttctatttgtgatgaaagaggtcaagaattgatttatgctggtatgccaattactgaagtttttaaagaagaaatgggtattggtggtgttttgggtttgttgtggtttcaaaaaagattgccaaaatattcttgtcaatttattgaaatgtgtttgatggttactgctgatcatggtccagctgtttctggtgctcataatactattatttgtgctagagctggtaaagatttggtttcttctttgacttctggtttgttgactattggtgatagatttggtggtgctttggatgctgctgctaaaatgttttctaaagcttttgattctggtattattccaatggaatttgttaataaaatgaaaaaagaaggtaaattgattatgggtattggtcatagagttaaatctattaataatccagatatgagagttcaaattttgaaagattatgttagacaacattttccagctactccattgttggattatgctttggaagttgaaaaaattactacttctaaaaaaccaaatttgattttgaatgttgatggtttgattggtgttgcttttgttgatatgttgagaaattgtggttcttttactagagaagaagctgatgaatatattgatattggtgctttgaatggtatttttgttttgggtagatctatgggttttattggtcattatttggatcaaaaaagattgaaacaaggtttgtatagacatccatgggatgatatttcttatgttttgccagaacatatgtctatgaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttcttcttattatcatcatcatcatcatcatttggaatctacttctttgtataaaaaagctggttctggttctaatttggttgctcaattggaaaatgaagttgcttctttggaaaatgaaaatgaaactttgaaaaaaaaaaatttgcataaaaaagatttgattgcttatttggaaaaagaaattgctaatttgagaaaaaaaattgaagaaggttctgctggttctgctgctggttctggtgaatttggttctgctgaagctgctgctaaagaagctgctgctaaagctggttctgctggttctgctgctggttctggtgaatttggttcttcttattatcatcatcatcatcatcatttggaatctacttctttgtataaaaaagctggttctggttctgctagaaatgcttatttgagaaaaaaaattgctagattgaaaaaagataatttgcaattggaaagagatgaacaaaatttggaaaaaattattgctaatttgagagatgaaattgctagattggaaaatgaagttgcttctcatgaacaa

SEQ ID NO: 142 - DNA, 2463 bp, Artificial Sequence
  encodes chimeric enzyme
atgaaaaattgtgttattgtttctgctgttagaactgctattggttcttttaatggttctttggcttctacttctgctattgatttgggtgctactgttattaaagctgctattgaaagagctaaaattgattctcaacatgttgatgaagttattatgggtaatgttttgcaagctggtttgggtcaaaatccagctagacaagctttgttgaaatctggtttggctgaaactgtttgtggttttactgttaataaagtttgtggttctggtttgaaatctgttgctttggctgctcaagctattcaagctggtcaagctcaatctattgttgctggtggtatggaaaatatgtctttggctccatatttgttggatgctaaagctagatctggttatagattgggtgatggtcaagtttatgatgttattttgagagatggtttgatgtgtgctactcatggttatcatatgggtattactgctgaaaatgttgctaaagaatatggtattactagagaaatgcaagatgaattggctttgcattctcaaagaaaagctgctgctgctattgaatctggtgcttttactgctgaaattgttccagttaatgttgttactagaaaaaaaacttttgttttttctcaagatgaatttccaaaagctaattctactgctgaagctttgggtgctttgagaccagcttttgataaagctggtactgttactgctggtaatgcttctggtattaatgatggtgctgctgctttggttattatggaagaatctgctgctttggctgctggtttgactccattggctagaattaaatcttatgcttctggtggtgttccaccagctttgatgggtatgggtccagttccagctactcaaaaagctttgcaattggctggtttgcaattggctgatattgatttgattgaagctaatgaagcttttgctgctcaatttttggctgttggtaaaaatttgggttttgattctgaaaaagttaatgttaatggtggtgctattgctttgggtcatccaattggtgcttctggtgctagaattttggttactttgttgcatgctatgcaagctagagataaaactttgggtttggctactttgtgtattggtggtggtcaaggtattgctatggttattgaaagattgaataaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttcttcttattatcatcatcatcatcatcatttggaatctacttctttgtataaaaaagctggttctggttctaatgaagttactactttggaaaatgatgctgcttttattgaaaatgaaaatgcttatttggaaaaagaaattgctagattgagaaaagaaaaagctgctttgagaaatagattggctcataaaaaaggttctgctggttctgctgctggttctggtgaatttggttctgctgaagctgctgctaaagaagctgctgctaaagctggttctgctggttctgctgctggttctggtgaatttggttcttcttattatcatcatcatcatcatcatttggaatctacttctttgtataaaaaagctggttctggttctcaaaaagttgctgaattgaaaaatagagttgctgttaaattgaatagaaatgaacaattgaaaaataaagttgaagaattgaaaaatagaaatgcttatttgaaaaatgaattggctactttggaaaatgaagttgctagattggaaaatgatgttgctgaa

SEQ ID NO: 143 - DNA, 2328 bp, Artificial Sequence
  encodes chimeric enzyme
atgaaaaaagtttgtgttattggtgctggtactatgggttctggtattgctcaagcttttgctgctaaaggttttgaagttgttttgagagatattaaagatgaatttgttgatagaggtttggattttattaataaaaatttgtctaaattggttaaaaaaggtaaaattgaagaagctactaaagttgaaattttgactagaatttctggtactgttgatttgaatatggctgctgattgtgatttggttattgaagctgctgttgaaagaatggatattaaaaaacaaatttttgctgatttggataatatttgtaaaccagaaactattttggcttctaatacttcttctttgtctattactgaagttgcttctgctactaaaagaccagataaagttattggtatgcatttttttaatccagctccagttatgaaattggttgaagttattagaggtattgctacttctcaagaaacttttgatgctgttaaagaaacttctattgctattggtaaagatccagttgaagttgctgaagctccaggttttgttgttaatagaattttgattccaatgattaatgaagctgttggtattttggctgaaggtattgcttctgttgaagatattgataaagctatgaaattgggtgctaatcatccaatgggtccattggaattgggtgattttattggtttggatatttgtttggctattatggatgttttgtattctgaaactggtgattctaaatatagaccacatactttgttgaaaaaatatgttagagctggttggttgggtagaaaatctggtaaaggtttttatgattattctaaaaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttctgaaaatttgtattttcaaggtgaaaatttgtattttcaaggtgattcttctgaatcttgttggaattgtggtagaaaagcttctgaaacttgttctggttgtaatactgctagatattgtggttctttttgtcaacataaagattgggaaaaacatcatcatatttgtggtcaaactttgcaagctcaacaaggttctgctggttctgctgctggttctggtgaatttggttctgctgaagctgctgctaaagaagctgctgctaaagctggttctgctggttctgctgctggttctggtgaatttggttctatggctgtttctgaatctcaattgaaaaaaatggtttctaaatataaatatagagatttgactgttagagaaactgttaatgttattactttgtataaagatttgaaaccagttttggattcttatgtttttaatgatggttcttctagagaattgatgaatttgactggtactattccagttccatatagaggtaatacttataatattccaatttgtttgtggttgttggatacttatccatataatccaccaatttgttttgttaaaccaacttcttctatgactattaaaactggtaaacatgttgatgctaatggtaaaatttatttgccatatttgcatgaatggaaacatccacaatctgatttgttgggtttgattcaagttatgattgttgtttttggtgatgaaccaccagttttttctagacca

SEQ ID NO: 144 - DNA, 2223 bp, Artificial Sequence
  encodes chimeric enzyme
atggaattgaataatgttattttggaaaaagaaggtaaagttgctgttgttactattaatagaccaaaagctttgaatgctttgaattctgatactttgaaagaaatggattatgttattggtgaaattgaaaatgattctgaagttttggctgttattttgactggtgctggtgaaaaatcttttgttgctggtgctgatatttctgaaatgaaagaaatgaatactattgaaggtagaaaatttggtattttgggtaataaagtttttagaagattggaattgttggaaaaaccagttattgctgctgttaatggttttgctttgggtggtggttgtgaaattgctatgtcttgtgatattagaattgcttcttctaatgctagatttggtcaaccagaagttggtttgggtattactccaggttttggtggtactcaaagattgtctagattggttggtatgggtatggctaaacaattgatttttactgctcaaaatattaaagctgatgaagctttgagaattggtttggttaataaagttgttgaaccatctgaattgatgaatactgctaaagaaattgctaataaaattgtttctaatgctccagttgctgttaaattgtctaaacaagctattaatagaggtatgcaatgtgatattgatactgctttggcttttgaatctgaagcttttggtgaatgtttttctactgaagatcaaaaagatgctatgactgcttttattgaaaaaagaaaaattgaaggttttaaaaatagaaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttctggtccattgggttctccattgactgcttctatgttggcttctgctccaccacaagaacaaaaacaaatgttgggtgaaagattgtttccattgattcaagctatgcatccaactttggctggtaaaattactggtatgttgttggaaattgataattctgaattgttgcatatgttggaatctccagaatctttgagatctaaagttgatgaagctgttgctgttttgcaagctcatcaagctaaagaagctgctcaaaaagctggttctgctggttctgctgctggttctggtgaatttggttctgctgaagctgctgctaaagaagctgctgctaaagctggttctgctggttctgctgctggttctggtgaatttggttctaatactaatatgtctgttccaactgatggtgctgttactacttctcaaattccagcttctgaacaagaaactttggttagaccaaaaccattgttgttgaaattgttgaaatctgttggtgctcaaaaagatacttatactatgaaagaagttttgttttatttgggtcaatatattatgactaaaagattgtatgatgaaaaacaacaacatattgtttattgttctaatgatttgttgggtgatttgtttggtgttccatctttttctgttaaagaacatagaaaaatttatactatgatttatagaaatttggttgtt

SEQ ID NO: 145 - DNA, 2460 bp, Artificial Sequence
  encodes chimeric enzyme
atgattgttaaaccaatggttagaaataatatttgtttgaatgctcatccacaaggttgtaaaaaaggtgttgaagatcaaattgaatatactaaaaaaagaattactgctgaagttaaagctggtgctaaagctccaaaaaatgttttggttttgggttgttctaatggttatggtttggcttctagaattactgctgcttttggttatggtgctgctactattggtgtttcttttgaaaaagctggttctgaaactaaatatggtactccaggttggtataataatttggcttttgatgaagctgctaaaagagaaggtttgtattctgttactattgatggtgatgctttttctgatgaaattaaagctcaagttattgaagaagctaaaaaaaaaggtattaaatttgatttgattgtttattctttggcttctccagttagaactgatccagatactggtattatgcataaatctgttttgaaaccatttggtaaaacttttactggtaaaactgttgatccatttactggtgaattgaaagaaatttctgctgaaccagctaatgatgaagaagctgctgctactgttaaagttatgggtggtgaagattgggaaagatggattaaacaattgtctaaagaaggtttgttggaagaaggttgtattactttggcttattcttatattggtccagaagctactcaagctttgtatagaaaaggtactattggtaaagctaaagaacatttggaagctactgctcatagattgaataaagaaaatccatctattagagcttttgtttctgttaataaaggtttggttactagagcttctgctgttattccagttattccattgtatttggcttctttgtttaaagttatgaaagaaaaaggtaatcatgaaggttgtattgaacaaattactagattgtatgctgaaagattgtatagaaaagatggtactattccagttgatgaagaaaatagaattagaattgatgattgggaattggaagaagatgttcaaaaagctgtttctgctttgatggaaaaagttactggtgaaaatgctgaatctttgactgatttggctggttatagacatgattttttggcttctaatggttttgatgttgaaggtattaattatgaagctgaagttgaaagatttgatagaattaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttcttcttattatcatcatcatcatcatcatttggaatctacttctttgtataaaaaagctggttctggttctaatttgttggctactttgagatctactgctgctgttttggaaaatgaaaatcatgttttggaaaaagaaaaagaaaaattgagaaaagaaaaagaacaattgttgaataaattggaagcttataaaggttctgctggttctgctgctggttctggtgaatttggttctgctgaagctgctgctaaagaagctgctgctaaagctggttctgctggttctgctgctggttctggtgaatttggttcttcttattatcatcatcatcatcatcatttggaatctacttctttgtataaaaaagctggttctggttctaaaagaattgcttatttgagaaaaaaaattgctgctttgaaaaaagataatgctaatttggaaaaagatattgctaatttggaaaatgaaattgaaagattgattaaagaaattaaaactttggaaaatgaagttgcttctcatgaacaa

SEQ ID NO: 146 - DNA, 2478 bp, Artificial Sequence
  encodes chimeric enzyme
atgactagagaagttgttgttgtttctggtgttagaactgctattggtacttttggtggttctttgaaagatgttgctccagctgaattgggtgctttggttgttagagaagctttggctagagctcaagtttctggtgatgatgttggtcatgttgtttttggtaatgttattcaaactgaaccaagagatatgtatttgggtagagttgctgctgttaatggtggtgttactattaatgctccagctttgactgttaatagattgtgtggttctggtttgcaagctattgtttctgctgctcaaactattttgttgggtgatactgatgttgctattggtggtggtgctgaatctatgtctagagctccatatttggctccagctgctagatggggtgctagaatgggtgatgctggtttggttgatatgatgttgggtgctttgcatgatccatttcatagaattcatatgggtgttactgctgaaaatgttgctaaagaatatgatatttctagagctcaacaagatgaagctgctttggaatctcatagaagagcttctgctgctattaaagctggttattttaaagatcaaattgttccagttgtttctaaaggtagaaaaggtgatgttacttttgatactgatgaacatgttagacatgatgctactattgatgatatgactaaattgagaccagtttttgttaaagaaaatggtactgttactgctggtaatgcttctggtttgaatgatgctgctgctgctgttgttatgatggaaagagctgaagctgaaagaagaggtttgaaaccattggctagattggtttcttatggtcatgctggtgttgatccaaaagctatgggtattggtccagttccagctactaaaattgctttggaaagagctggtttgcaagtttctgatttggatgttattgaagctaatgaagcttttgctgctcaagcttgtgctgttactaaagctttgggtttggatccagctaaagttaatccaaatggttctggtatttctttgggtcatccaattggtgctactggtgctttgattactgttaaagctttgcatgaattgaatagagttcaaggtagatatgctttggttactatgtgtattggtggtggtcaaggtattgctgctatttttgaaagaattaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttctgatgttatgtgggaatataaatgggaaaatactggtgatgctgaattgtatggtccatttacttctgctcaaatgcaaacttgggtttctgaaggttattttccagatggtgtttattgtagaaaattggatccaccaggtggtcaattttataattctaaaagaattgattttgatttgtatactggttctgctggttctgctgctggttctggtgaatttggttctgctgaagctgctgctaaagaagctgctgctaaagctggttctgctggttctgctgctggttctggtgaatttggttctgaatctgattctgttgaatttaataatgctatttcttatgttaataaaattaaaactagatttttggatcatccagaaatttatagatcttttttggaaattttgcatacttatcaaaaagaacaattgcatactaaaggtagaccatttagaggtatgtctgaagaagaagtttttactgaagttgctaatttgtttagaggtcaagaagatttgttgtctgaatttggtcaatttttgccagaagctaaaaga

SEQ ID NO: 147 - DNA, 2550 bp, Artificial Sequence
  encodes chimeric enzyme
atgaaactctcaactaaactttgttggtgtggtattaaaggaagacttaggccgcaaaagcaacaacaattacacaatacaaacttgcaaatgactgaactaaaaaaacaaaagaccgctgaacaaaaaaccagacctcaaaatgtcggtattaaaggtatccaaatttacatcccaactcaatgtgtcaaccaatctgagctagagaaatttgatggcgtttctcaaggtaaatacacaattggtctgggccaaaccaacatgtcttttgtcaatgacagagaagatatctactcgatgtccctaactgttttgtctaagttgatcaagagttacaacatcgacaccaacaaaattggtagattagaagtcggtactgaaactctgattgacaagtccaagtctgtcaagtctgtcttgatgcaattgtttggtgaaaacactgacgtcgaaggtattgacacgcttaatgcctgttacggtggtaccaacgcgttgttcaactctttgaactggattgaatctaacgcatgggatggtagagacgccattgtagtttgcggtgatattgccatctacgataagggtgccgcaagaccaaccggtggtgccggtactgttgctatgtggatcggtcctgatgctccaattgtatttgactctgtaagagcttcttacatggaacacgcctacgatttttacaagccagatttcaccagcgaatatccttacgtcgatggtcatttttcattaacttgttacgtcaaggctcttgatcaagtttacaagagttattccaagaaggctatttctaaagggttggttagcgatcccgctggttcggatgctttgaacgttttgaaatatttcgactacaacgttttccatgttccaacctgtaaattggtcacaaaatcatacggtagattactatataacgatttcagagccaatcctcaattgttcccagaagttgacgccgaattagctactcgcgattatgacgaatctttaaccgataagaacattgaaaaaacttttgttaatgttgctaagccattccacaaagagagagttgcccaatctttgattgttccaacaaacacaggtaacatgtacaccgcatctgtttatgccgcctttgcatctctattaaactatgttggatctgacgacttacaaggcaagcgtgttggtttattttcttacggttccggtttagctgcatctctatattcttgcaaaattgttggtgacgtccaacatattatcaaggaattagatattactaacaaattagccaagagaatcaccgaaactccaaaggattacgaagctgccatcgaattgagagaaaatgcccatttgaagaagaacttcaaacctcaaggttccattgagcatttgcaaagtggtgtttactacttgaccaacatcgatgacaaatttagaagatcttacgatgttaaaaaataaaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttctttgggtccattgccaccaggttgggaagttagatctactgtttctggtagaatttattttgttgatcataataatagaactactcaatttactgatccaagattgcatggttctgctggttctgctgctggttctggtgaatttggttctgctgaagctgctgctaaagaagctgctgctaaagctggttctgctggttctgctgctggttctggtgaatttggttctggtgctatgggtccattgccaccaggttgggaaaaaagaactgattctaatggtagagtttattttgttaatcataatactagaattactcaatgggaagatccaagatct

SEQ ID NO: 148 - DNA, 2478 bp, Artificial Sequence
  encodes chimeric enzyme
atggttgcggtacgtaggaaggctctttcaattttggcagaagctcctgtattagcatctgatcgtttaccatataaaaattatgactacgaccgcgtatttggcgcttgttgtgaaaatgttataggttacatgcctttgcccgttggtgttataggccccttggttatcgatggtacatcttatcatataccaatggcaactacagagggttgtttggtagcttctgccatgcgtggctgtaaggcaatcaatgctggcggtggtgcaacaactgttttaactaaggatggtatgacaagaggcccagtagtccgtttcccaactttgaaaagatctggtgcctgtaagatatggttagactcagaagagggacaaaacgcaattaaaaaagcttttaactctacatcaagatttgcacgtctgcaacatattcaaacttgtctagcaggagatttactcttcatgagatttagaacaactactggtgacgcaatgggtatgaatatgatttctaaaggtgtcgaatactcattaaagcaaatggtagaagagtatggctgggaagatatggaggttgtctccgtttctggtaactactgtaccgacaaaaaaccagctgccatcaactggatcgaaggtcgtggtaagagtgtcgtcgcagaagctactattcctggtgatgttgtcagaaaagtgttaaaaagtgatgtttccgcattggttgagttgaacattgctaagaatttggttggatctgcaatggctgggtctgttggtggatttaacgcacatgcagctaatttagtgacagctgttttcttggcattaggacaagatcctgcacaaaatgttgaaagttccaactgtataacattgatgaaagaagtggacggtgatttgagaatttccgtatccatgccatccatcgaagtaggtaccatcggtggtggtactgttctagaaccacaaggtgccatgttggacttattaggtgtaagaggcccgcatgctaccgctcctggtaccaacgcacgtcaattagcaagaatagttgcctgtgccgtcttggcaggtgaattatccttatgtgctgccctagcagccggccatttggttcaaagtcatatgacccacaacaggaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttcttcttattatcatcatcatcatcatcatttggaatctacttctttgtataaaaaagctggttctgaattttttagaagagaaagaaataaaatggctgctgctaaatgtagaaatagaagaagagaattgactgatactttgcaagctgaaactgatcaattggaagatgaaaaatctgctttgcaaactgaaattgctaatttgttgaaagaaaaagaaaaattggaatttattttggctgctcatagaccagcttgtaaaattccagatgatttgggttttccagaagaaatgtctttggaaggttctgctggttctgctgctggttctggtgaatttggttctgctgaagctgctgctaaagaagctgctgctaaagctggttctgctggttctgctgctggttctggtgaatttggttcttcttattatcatcatcatcatcatcatttggaatctacttctttgtataaaaaagctggttctggttctcaaaaagttgaatctttgaaacaaaaaattgaagaattgaaacaaagaaaagctcaattgaaaaatgatattgctaatttggaaaaagaaattgcttatgctgaaact

SEQ ID NO: 149 - DNA, 3141 bp, Artificial Sequence
  encodes chimeric enzyme
atgtcattaccgttcttaacttctgcaccgggaaaggttattatttttggtgaacactctgctgtgtacaacaagcctgccgtcgctgctagtgtgtctgcgttgagaacctacctgctaataagcgagtcatctgcaccagatactattgaattggacttcccggacattagctttaatcataagtggtccatcaatgatttcaatgccatcaccgaggatcaagtaaactcccaaaaattggccaaggctcaacaagccaccgatggcttgtctcaggaactcgttagtcttttggatccgttgttagctcaactatccgaatccttccactaccatgcagcgttttgtttcctgtatatgtttgtttgcctatgcccccatgccaagaatattaagttttctttaaagtctactttacccatcggtgctgggttgggctcaagcgcctctatttctgtatcactggccttagctatggcctacttgggggggttaataggatctaatgacttggaaaagctgtcagaaaacgataagcatatagtgaatcaatgggccttcataggtgaaaagtgtattcacggtaccccttcaggaatagataacgctgtggccacttatggtaatgccctgctatttgaaaaagactcacataatggaacaataaacacaaacaattttaagttcttagatgatttcccagccattccaatgatcctaacctatactagaattccaaggtctacaaaagatcttgttgctcgcgttcgtgtgttggtcaccgagaaatttcctgaagttatgaagccaattctagatgccatgggtgaatgtgccctacaaggcttagagatcatgactaagttaagtaaatgtaaaggcaccgatgacgaggctgtagaaactaataatgaactgtatgaacaactattggaattgataagaataaatcatggactgcttgtctcaatcggtgtttctcatcctggattagaacttattaaaaatctgagcgatgatttgagaattggctccacaaaacttaccggtgctggtggcggcggttgctctttgactttgttacgaagagacattactcaagagcaaattgacagcttcaaaaagaaattgcaagatgattttagttacgagacatttgaaacagacttgggtgggactggctgctgtttgttaagcgcaaaaaatttgaataaagatcttaaaatcaaatccctagtattccaattatttgaaaataaaactaccacaaagcaacaaattgacgatctattattgccaggaaacacgaatttaccatggacttcataaaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttctatggaaccagctatggaaccagaaactttggaagctagaattaatagagctactaatccattgaataaagaattggattgggcttctattaatggtttttgtgaacaattgaatgaagattttgaaggtccaccattggctactagattgttggctcataaaattcaatctccacaagaatgggaagctattcaagctttgactgttttggaaacttgtatgaaatcttgtggtaaaagatttcatgatgaagttggtaaatttagatttttgaatgaattgattaaagttgtttctccaaaatatttgggttctagaacttctgaaaaagttaaaaataaaattttggaattgttgtattcttggactgttggtttgccagaagaagttaaaattgctgaagcttatcaaatgttgaaaaaacaaggtattgttaaatctggttctgctggttctgctgctggttctggtgaatttggttctgctgaagctgctgctaaagaagctgctgctaaagctggttctgctggttctgctgctggttctggtgaatttggttctggtgctatgggttctatggctgaagctgaaggtgaatctttggaatcttggttgaataaagctactaatccatctaatagacaagaagattgggaatatattattggtttttgtgatcaaattaataaagaattggaaggtccacaaattgctgttagattgttggctcataaaattcaatctccacaagaatgggaagctttgcaagctttgactgttttggaagcttgtatgaaaaattgtggtagaagatttcataatgaagttggtaaatttagatttttgaatgaattgattaaagttgtttctccaaaatatttgggtgatagagtttctgaaaaagttaaaactaaagttattgaattgttgtattcttggactatggctttgccagaagaagctaaaattaaagatgcttatcatatgttgaaaagacaaggtattgttcaatctgatccaccaattccagttgatagaactttgattccatctccaccaccaagaccaaaaaat

SEQ ID NO: 150 - DNA, 2604 bp, Artificial Sequence
  encodes chimeric enzyme
atgtcagagttgagagccttcagtgccccagggaaagcgttactagctggtggatatttagttttagatacaaaatatgaagcatttgtagtcggattatcggcaagaatgcatgctgtagcccatccttacggttcattgcaagggtctgataagtttgaagtgcgtgtgaaaagtaaacaatttaaagatggggagtggctgtaccatataagtcctaaaagtggcttcattcctgtttcgataggcggatctaagaaccctttcattgaaaaagttatcgctaacgtatttagctactttaaacctaacatggacgactactgcaatagaaacttgttcgttattgatattttctctgatgatgcctaccattctcaggaggatagcgttaccgaacatcgtggcaacagaagattgagttttcattcgcacagaattgaagaagttcccaaaacagggctgggctcctcggcaggtttagtcacagttttaactacagctttggcctccttttttgtatcggacctggaaaataatgtagacaaatatagagaagttattcataatttagcacaagttgctcattgtcaagctcagggtaaaattggaagcgggtttgatgtagcggcggcagcatatggatctatcagatatagaagattcccacccgcattaatctctaatttgccagatattggaagtgctacttacggcagtaaactggcgcatttggttgatgaagaagactggaatattacgattaaaagtaaccatttaccttcgggattaactttatggatgggcgatattaagaatggttcagaaacagtaaaactggtccagaaggtaaaaaattggtatgattcgcatatgccagaaagcttgaaaatatatacagaactcgatcatgcaaattctagatttatggatggactatctaaactagatcgcttacacgagactcatgacgattacagcgatcagatatttgagtctcttgagaggaatgactgtacctgtcaaaagtatcctgaaatcacagaagttagagatgcagttgccacaattagacgttcctttagaaaaataactaaagaatctggtgccgatatcgaacctcccgtacaaactagcttattggatgattgccagaccttaaaaggagttcttacttgcttaatacctggtgctggtggttatgacgccattgcagtgattactaagcaagatgttgatcttagggctcaaaccgctaatgacaaaagattttctaaggttcaatggctggatgtaactcaggctgactggggtgttaggaaagaaaaagatccggaaacttatcttgataaataaaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttcttcttattatcatcatcatcatcatcatttggaatctacttctttgtataaaaaagctggttctggttctcaaaaagttgaagaattgaaaaataaaattgctgaattggaaaatagaaatgctgttaaaaaaaatagagttgctcatttgaaacaagaaattgcttatttgaaagatgaattggctgctcatgaatttgaaggttctgctggttctgctgctggttctggtgaatttggttctgctgaagctgctgctaaagaagctgctgctaaagctggttctgctggttctgctgctggttctggtgaatttggttcttcttattatcatcatcatcatcatcatttggaatctacttctttgtataaaaaagctggttctggttcttttgaaaatgttactcatgaatttattttggctactttggaaaatgaaaatgctaaattgagaagattggaagctaaattggaaagagaattggctagattgagaaatgaagttgcttggttg

SEQ ID NO: 151 - DNA, 3027 bp, Artificial Sequence
  encodes chimeric enzyme
atgaccgtttacacagcatccgttaccgcacccgtcaacatcgcaacccttaagtattgggggaaaagggacacgaagttgaatctgcccaccaattcgtccatatcagtgactttatcgcaagatgacctcagaacgttgacctctgcggctactgcacctgagtttgaacgcgacactttgtggttaaatggagaaccacacagcatcgacaatgaaagaactcaaaattgtctgcgcgacctacgccaattaagaaaggaaatggaatcgaaggacgcctcattgcccacattatctcaatggaaactccacattgtctccgaaaataactttcctacagcagctggtttagcttcctccgctgctggctttgctgcattggtctctgcaattgctaagttataccaattaccacagtcaacttcagaaatatctagaatagcaagaaaggggtctggttcagcttgtagatcgttgtttggcggatacgtggcctgggaaatgggaaaagctgaagatggtcatgattccatggcagtacaaatcgcagacagctctgactggcctcagatgaaagcttgtgtcctagttgtcagcgatattaaaaaggatgtgagttccactcagggtatgcaattgaccgtggcaacctccgaactatttaaagaaagaattgaacatgtcgtaccaaagagatttgaagtcatgcgtaaagccattgttgaaaaagatttcgccacctttgcaaaggaaacaatgatggattccaactctttccatgccacatgtttggactctttccctccaatattctacatgaatgacacttccaagcgtatcatcagttggtgccacaccattaatcagttttacggagaaacaatcgttgcatacacgtttgatgcaggtccaaatgctgtgttgtactacttagctgaaaatgagtcgaaactctttgcatttatctataaattgtttggctctgttcctggatgggacaagaaatttactactgagcagcttgaggctttcaaccatcaatttgaatcatctaactttactgcacgtgaattggatcttgagttgcaaaaggatgttgccagagtgattttaactcaagtcggttcaggcccacaagaaacaaacgaatctttgattgacgcaaagactggtctaccaaaggaataaaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttctgctatggctgatttggaacaaaaagttttggaaatggaagcttctacttatgatggtgtttttatttggaaaatttctgattttccaagaaaaagacaagaagctgttgctggtagaattccagctattttttctccagctttttatacttctagatatggttataaaatgtgtttgagaatttatttgaatggtgatggtactggtagaggtactcatttgtctttgttttttgttgttatgaaaggtccaaatgatgctttgttgagatggccatttaatcaaaaagttactttgatgttgttggatcaaaataatagagaacatgttattgatgcttttagaccagatgttacttcttcttcttttcaaagaccagttaatgatatgaatattgcttctggttgtccattgttttgtccagtttctaaaatggaagctaaaaattcttatgttagagatgatgctatttttattaaagctattgttgatttgactggtttgggttctgctggttctgctgctggttctggtgaatttggttctgctgaagctgctgctaaagaagctgctgctaaagctggttctgctggttctgctgctggttctggtgaatttggttctgcttctattaaattgcaatcttctgatggtgaaatttttgaagttgatgttgaaattgctaaacaatctgttactattaaaactatgttggaagatttgggtatggatgatgaaggtgatgatgatccagttccattgccaaatgttaatgctgctattttgaaaaaagttattcaatggtgtactcatcataaagatgatccaccaccaccagaagatgatgaaaataaagaaaaaagaactgatgatattccagtttgggatcaagaatttttgaaagttgatcaaggtactttgtttgaattgattttggctgctaattatttggatattaaaggtttgttggatgttacttgtaaaactgttgctaatatgattaaaggtaaaactccagaagaaattagaaaaacttttaatattaaaaatgattttactgaagaagaagaagctcaagttagaaaagaaaatcaatggtgt

SEQ ID NO: 152 - DNA, 2154 bp, Artificial Sequence
  encodes chimeric enzyme
atgactgccgacaacaatagtatgccccatggtgcagtatctagttacgccaaattagtgcaaaaccaaacacctgaagacattttggaagagtttcctgaaattattccattacaacaaagacctaatacccgatctagtgagacgtcaaatgacgaaagcggagaaacatgtttttctggtcatgatgaggagcaaattaagttaatgaatgaaaattgtattgttttggattgggacgataatgctattggtgccggtaccaagaaagtttgtcatttaatggaaaatattgaaaagggtttactacatcgtgcattctccgtctttattttcaatgaacaaggtgaattacttttacaacaaagagccactgaaaaaataactttccctgatctttggactaacacatgctgctctcatccactatgtattgatgacgaattaggtttgaagggtaagctagacgataagattaagggcgctattactgcggcggtgagaaaactagatcatgaattaggtattccagaagatgaaactaagacaaggggtaagtttcactttttaaacagaatccattacatggcaccaagcaatgaaccatggggtgaacatgaaattgattacatcctattttataagatcaacgctaaagaaaacttgactgtcaacccaaacgtcaatgaagttagagacttcaaatgggtttcaccaaatgatttgaaaactatgtttgctgacccaagttacaagtttacgccttggtttaagattatttgcgagaattacttattcaactggtgggagcaattagatgacctttctgaagtggaaaatgacaggcaaattcatagaatgctataaaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttcttcttattatcatcatcatcatcatcatttggaatctacttctttgtataaaaaagctggttctggttctaatactgttaaagaattgaaaaattatattcaagaattggaagaaagaaatgctgaattgaaaaatttgaaagaacatttgaaatttgctaaagctgaattggaatttgaattggctgctcataaatttgaaggttctgctggttctgctgctggttctggtgaatttggttctgctgaagctgctgctaaagaagctgctgctaaagctggttctgctggttctgctgctggttctggtgaatttggttcttcttattatcatcatcatcatcatcatttggaatctacttctttgtataaaaaagctggttctggttctcaaaaagttgctcaattgaaaaatagagttgcttataaattgaaagaaaatgctaaattggaaaatattgttgctagattggaaaatgataatgctaatttggaaaaagatattgctaatttggaaaaagatattgctaatttggaaagagatgttgctaga

SEQ ID NO: 153 - DNA, 2448 bp, Artificial Sequence
  encodes chimeric enzyme
atggcttcagaaaaggaaataagaagagaaagattcttgaacgtattcccaaagttagttgaagaattgaacgctagtttgttagcttatggtatgcctaaagaagcctgcgattggtatgctcactctttaaactacaatactccaggtggtaaattgaatagaggtttgagtgtagttgatacttatgctatcttgtctaacaaaaccgttgaacaattaggtcaagaagaatacgaaaaggtcgctatcttgggttggtgtattgaattgttgcaagcatactttttggttgccgatgacatgatggataagtctataacaagaagaggtcaaccatgctggtacaaagttccagaagttggtgaaatagccataaatgatgcttttatgttggaagccgctatctataaattgttgaagtcacatttcagaaacgaaaagtactacatcgatattaccgaattattccacgaagttactttccaaacagaattgggtcaattgatggatttgataactgcacctgaagataaagttgacttgtcaaagttttccttgaagaaacattcattcatcgtcacctttgaaactgcttattactccttctatttgccagtcgccttggctatgtacgtagctggtattactgatgaaaaagacttgaagcaagcaagagatgttttgatacctttgggtgaatacttccaaatccaagatgactacttagactgtttcggtactccagaacaaataggtaaaatcggtacagatattcaagacaataagtgcagttgggttattaacaaggctttggaattagcatctgccgaacaaagaaagactttggatgaaaactacggtaaaaaggactcagttgctgaagcaaagtgtaagaaaatttttaatgatttgaagattgaacaattgtaccatgaatacgaagaatccatcgctaaagacttaaaggcaaagattagtcaagttgatgaatcaagaggttttaaagccgacgttttgacagctttcttgaataaggtctacaagagatcaaagtagaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttctttgtgtactatgaaaaaaggtccatctggttatggttttaatttgcattctgataaatctaaaccaggtcaatttattagatctgttgatccagattctccagctgaagcttctggtttgagagctcaagatagaattgttgaagttaatggtgtttgtatggaaggtaaacaacatggtgatgttgtttctgctattagagctggtggtgatgaaactaaattgttggttgttgatagagaaggttctgctggttctgctgctggttctggtgaatttggttctgctgaagctgctgctaaagaagctgctgctaaagctggttctgctggttctgctgctggttctggtgaatttggttcttcttctggtgctattatttatactgttgaattgaaaagatatggtggtccattgggtattactatttctggtactgaagaaccatttgatccaattattatttcttctttgactaaaggtggtttggctgaaagaactggtgctattcatattggtgatagaattttggctattaattcttcttctttgaaaggtaaaccattgtctgaagctattcatttgttgcaaatggctggtgaaactgttactttgaaaattaaaaaacaaactgatgctcaaccagcttcttct

SEQ ID NO: 154 - DNA, 2649 bp, Artificial Sequence
  encodes chimeric enzyme
atgaatcatttgagagctgaaggtccagcttctgttttggctattggtactgctaatccagaaaatattttgttgcaagatgaatttccagattattattttagagttactaaatctgaacatatgactcaattgaaagaaaaatttagaaaaatttgtgataaatctatgattagaaaaagaaattgttttttgaatgaagaacatttgaaacaaaatccaagattggttgaacatgaaatgcaaactttggatgctagacaagatatgttggttgttgaagttccaaaattgggtaaagatgcttgtgctaaagctattaaagaatggggtcaaccaaaatctaaaattactcatttgatttttacttctgcttctactactgatatgccaggtgctgattatcattgtgctaaattgttgggtttgtctccatctgttaaaagagttatgatgtatcaattgggttgttatggtggtggtactgttttgagaattgctaaagatattgctgaaaataataaaggtgctagagttttggctgtttgttgtgatattatggcttgtttgtttagaggtccatctgaatctgatttggaattgttggttggtcaagctatttttggtgatggtgctgctgctgttattgttggtgctgaaccagatgaatctgttggtgaaagaccaatttttgaattggtttctactggtcaaactattttgccaaattctgaaggtactattggtggtcatattagagaagctggtttgatttttgatttgcataaagatgttccaatgttgatttctaataatattgaaaaatgtttgattgaagcttttactccaattggtatttctgattggaattctattttttggattactcatccaggtggtaaagctattttggataaagttgaagaaaaattgcatttgaaatctgataaatttgttgattctagacatgttttgtctgaacatggtaatatgtcttcttctactgttttgtttgttatggatgaattgagaaaaagatctttggaagaaggtaaatctactactggtgatggttttgaatggggtgttttgtttggttttggtccaggtttgactgttgaaagagttgttgttagatctgttccaattaaatataaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttctggtaataatttggaaacttatgaatggtataataaatctatttctagagataaagctgaaaaattgttgttggatactggtaaagaaggtgcttttatggttagagattctagaactccaggtacttatactgtttctgtttttactaaagctattatttctgaaaatccatgtattaaacattatcatattaaagaaactaatgattctccaaaaagatattatgttgctgaaaaatatgtttttgattctattccattgttgattcaatatcatcaatataatggtggtggtttggttactagattgagatatccagtttgtggtggttctgctggttctgctgctggttctggtgaatttggttctgctgaagctgctgctaaagaagctgctgctaaagctggttctgctggttctgctgctggttctggtgaatttggttctggttctcatccatggttttttggtaaaattccaagagctaaagctgaagaaatgttgtctaaacaaagacatgatggtgcttttttgattagagaatctgaatctgctccaggtgatttttctttgtctgttaaatttggtaatgatgttcaacattttaaagttttgagagatggtgctggtaaatattttttgtgggttgttaaatttaattctttgaatgaattggttgattatcatagatctacttctgtttctagaaatcaacaaatttttttgagagatattgaacaagttccacaacaaccaact

SEQ ID NO: 155 - DNA, 1995 bp, Artificial Sequence
  encodes chimeric enzyme
atggctgttaaacatttgattgttttgaaatttaaagatgaaattactgaagctcaaaaagaagaattttttaaaacttatgttaatttggttaatattattccagctatgaaagatgtttattggggtaaagatgttactcaaaaaaataaagaagaaggttatactcatattgttgaagttacttttgaatctgttgaaactattcaagattatattattcatccagctcatgttggttttggtgatgtttatagatctttttgggaaaaattgttgatttttgattatactccaagaaaaaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttctggtcaagatagatctgaagctactttgattaaaagatttaaaggtgaaggtgttagatataaagctaaattgattggtattgatgaagtttctgctgctagaggtgataaattgtgtcaagattctatgatgaaattgaaaggtgttgttgctggtgctagatctaaaggtgaacataaacaaaaaatttttttgactatttcttttggtggtattaaaatttttgatgaaaaaactggtgctttgcaacatcatcatgctgttcatgaaatttcttatattgctaaagatattactgatcatagagcttttggttatgtttgtggtaaagaaggtaatcatagatttgttgctattaaaactgctcaagctgctgaaccagttattttggatttgagagatttgtttcaattgatttatgaattgaaacaaagagaagaattggaaaaaaaagctggttctgctggttctgctgctggttctggtgaatttggttctgctgaagctgctgctaaagaagctgctgctaaagctggttctgctggttctgctgctggttctggtgaatttggttctggttctcatatgggttctcaattttgggttacttctcaaaaaactgaagcttctgaaagatgtggtttgcaaggttcttatattttgagagttgaagctgaaaaattgactttgttgactttgggtgctcaatctcaaattttggaaccattgttgttttggccatatactttgttgagaagatatggtagagataaagttatgttttcttttgaagctggtagaagatgtccatctggtccaggtacttttacttttcaaacttctcaaggtaatgatatttttcaagctgttgaagctgctattcaacaacaaaaagctcaaggtaaagttggtcaagctcaagatattttgagattggaacatcatcatcatcatcat

SEQ ID NO: 156 - DNA, 2391 bp, Artificial Sequence
  encodes chimeric enzyme
atgggtttgtcttctgtttgtactttttcttttcaaactaattatcatactttgttgaatccacataataataatccaaaaacttctttgttgtgttatagacatccaaaaactccaattaaatattcttataataattttccatctaaacattgttctactaaatcttttcatttgcaaaataaatgttctgaatctttgtctattgctaaaaattctattagagctgctactactaatcaaactgaaccaccagaatctgataatcattctgttgctactaaaattttgaattttggtaaagcttgttggaaattgcaaagaccatatactattattgcttttacttcttgtgcttgtggtttgtttggtaaagaattgttgcataatactaatttgatttcttggtctttgatgtttaaagcttttttttttttggttgctattttgtgtattgcttcttttactactactattaatcaaatttatgatttgcatattgatagaattaataaaccagatttgccattggcttctggtgaaatttctgttaatactgcttggattatgtctattattgttgctttgtttggtttgattattactattaaaatgaaaggtggtccattgtatatttttggttattgttttggtatttttggtggtattgtttattctgttccaccatttagatggaaacaaaatccatctactgcttttttgttgaattttttggctcatattattactaattttactttttattatgcttctagagctgctttgggtttgccatttgaattgagaccatcttttacttttttgttggcttttatgaaatctatgggttctgctttggctttgattaaagatgcttctgatgttgaaggtgatactaaatttggtatttctactttggcttctaaatatggttctagaaatttgactttgttttgttctggtattgttttgttgtcttatgttgctgctattttggctggtattatttggccacaagcttttaattctaatgttatgttgttgtctcatgctattttggctttttggttgattttgcaaactagagattttgctttgactaattatgatccagaagctggtagaagattttatgaatttatgtggaaattgtattatgctgaatatttggtttatgtttttattaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttctgctgaatatgttagagctttgtttgattttaatggtaatgatgaagaagatttgccatttaaaaaaggtgatattttgagaattagagataaaccagaagaacaatggtggaatgctgaagattctgaaggtaaaagaggtatgattccagttccatatgttgaaaaatatggttctgctggttctgctgctggttctggtgaatttggttctgctgaagctgctgctaaagaagctgctgctaaagctggttctgctggttctgctgctggttctggtgaatttggttctttgattaaacatatgagagctgaagctttgtttgattttactggtaattctaaattggaattgaattttaaagctggtgatgttatttttttgttgtctagaattaataaagattggttggaaggtactgttagaggtgctactggtatttttccattgtcttttgttaaaattttgaaa

SEQ ID NO: 157 - DNA, 8226 bp, Artificial Sequence
  encodes chimeric enzyme
atgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataatggtattgccgccgtgaaagaaattagatccgtcagaaaatgggcatacgagacgttcggcgatgacagaaccgtccaattcgtcgccatggccaccccagaagatctggaggccaacgcagaatatatccgtatggccgatcaatacattgaagtgccaggtggtactaataataacaactacgctaacgtagacttgatcgtagacatcgccgaaagagcagacgtagacgccgtatgggctggctggggtcacgcctccgagaatccactattgcctgaaaaattgtcccagtctaagaggaaagtcatctttattgggcctccaggtaacgccatgaggtctttaggtgataaaatctcctctaccattgtcgctcaaagtgctaaagtcccatgtattccatggtctggtaccggtgttgacaccgttcacgtggacgagaaaaccggtctggtctctgtcgacgatgacatctatcaaaagggttgttgtacctctcctgaagatggtttacaaaaggccaagcgtattggttttcctgtcatgattaaggcatccgaaggtggtggtggtaaaggtatcagacaagttgaacgtgaagaagatttcatcgctttataccaccaggcagccaacgaaattccaggctcccccattttcatcatgaagttggccggtagagcgcgtcacttggaagttcaactgctagcagatcagtacggtacaaatatttccttgttcggtagagactgttccgttcagagacgtcatcaaaaaattatcgaagaagcaccagttacaattgccaaggctgaaacatttcacgagatggaaaaggctgccgtcagactggggaaactagtcggttatgtctctgccggtaccgtggagtatctatattctcatgatgatggaaaattctactttttagaattgaacccaagattacaagtcgagcatccaacaacggaaatggtctccggtgttaacttacctgcagctcaattacaaatcgctatgggtatccctatgcatagaataagtgacattagaactttatatggtatgaatcctcattctgcctcagaaatcgatttcgaattcaaaactcaagatgccaccaagaaacaaagaagacctattccaaagggtcattgtaccgcttgtcgtatcacatcagaagatccaaacgatggattcaagccatcgggtggtactttgcatgaactaaacttccgttcttcctctaatgtttggggttacttctccgtgggtaacaatggtaatattcactccttttcggactctcagttcggccatatttttgcttttggtgaaaatagacaagcttccaggaaacacatggttgttgccctgaaggaattgtccattaggggtgatttcagaactactgtggaatacttgatcaaacttttggaaactgaagatttcgaggataacactattaccaccggttggttggacgatttgattactcataaaatgaccgctgaaaagcctgatccaactcttgccgtcatttgcggtgccgctacaaaggctttcttagcatctgaagaagcccgccacaagtatatcgaatccttacaaaagggacaagttctatctaaagacctactgcaaactatgttccctgtagattttatccatgagggtaaaagatacaagttcaccgtagctaaatccggtaatgaccgttacacattatttatcaatggttctaaatgtgatatcatactgcgtcaactatctgatggtggtcttttgattgccataggcggtaaatcgcataccatctattggaaagaagaagttgctgctacaagattatccgttgactctatgactactttgttggaagttgaaaacgatccaacccagttgcgtactccatcccctggtaaattggttaaattcttggtggaaaatggtgaacacattatcaagggccaaccatatgcagaaattgaagttatgaaaatgcaaatgcctttggtttctcaagaaaatggtatcgtccagttattaaagcaacctggttctaccattgttgcaggtgatatcatggctattatgactcttgacgatccatccaaggtcaagcacgctctaccatttgaaggtatgctgccagattttggttctccagttatcgaaggaaccaaacctgcctataaattcaagtcattagtgtctactttggaaaacattttgaagggttatgacaaccaagttattatgaacgcttccttgcaacaattgatagaggttttgagaaatccaaaactgccttactcagaatggaaactacacatctctgctttacattcaagattgcctgctaagctagatgaacaaatggaagagttagttgcacgttctttgagacgtggtgctgttttcccagctagacaattaagtaaattgattgatatggccgtgaagaatcctgaatacaaccccgacaaattgctgggcgccgtcgtggaaccattggcggatattgctcataagtactctaacgggttagaagcccatgaacattctatatttgtccatttcttggaagaatattacgaagttgaaaagttattcaatggtccaaatgttcgtgaggaaaatatcattctgaaattgcgtgatgaaaaccctaaagatctagataaagttgcgctaactgttttgtctcattcgaaagtttcagcgaagaataacctgatcctagctatcttgaaacattatcaaccattgtgcaagttatcttctaaagtttctgccattttctctactcctctacaacatattgttgaactagaatctaaggctaccgctaaggtcgctctacaagcaagagaaattttgattcaaggcgctttaccttcggtcaaggaaagaactgaacaaattgaacatatcttaaaatcctctgttgtgaaggttgcctatggctcatccaatccaaagcgctctgaaccagatttgaatatcttgaaggacttgatcgattctaattacgttgtgttcgatgttttacttcaattcctaacccatcaagacccagttgtgactgctgcagctgctcaagtctatattcgtcgtgcttatcgtgcttacaccataggagatattagagttcacgaaggtgtcacagttccaattgttgaatggaaattccaactaccttcagctgcgttctccacctttccaactgttaaatctaaaatgggtatgaacagggctgtttctgtttcagatttgtcatatgttgcaaacagtcagtcatctccgttaagagaaggtattttgatggctgtggatcatttagatgatgttgatgaaattttgtcacaaagtttggaagttattcctcgtcaccaatcttcttctaacggacctgctcctgatcgttctggtagctccgcatcgttgagtaatgttgctaatgtttgtgttgcttctacagaaggtttcgaatctgaagaggaaattttggtaaggttgagagaaattttggatttgaataagcaggaattaatcaatgcttctatccgtcgtatcacatttatgttcggttttaaagatgggtcttatccaaagtattatacttttaacggtccaaattataacgaaaatgaaacaattcgtcacattgagccggctttggccttccaactggaattaggaagattgtccaacttcaacattaaaccaattttcactgataatagaaacatccatgtctacgaagctgttagtaagacttctccattggataagagattctttacaagaggtattattagaacgggtcatatccgtgatgacatttctattcaagaatatctgacttctgaagctaacagattgatgagtgatatattggataatttagaagtcaccgacacttcaaattctgatttgaatcatatcttcatcaacttcattgcggtgtttgatatctctccagaagatgtcgaagccgccttcggtggtttcttagaaagatttggtaagagattgttgagattgcgtgtttcttctgccgaaattagaatcatcatcaaagatcctcaaacaggtgccccagtaccattgcgtgccttgatcaataacgtttctggttatgttatcaaaacagaaatgtacaccgaagtcaagaacgcaaaaggtgaatgggtatttaagtctttgggtaaacctggatccatgcatttaagacctattgctactccttaccctgttaaggaatggttgcaaccaaaacgttataaggcacacttgatgggtaccacatatgtctatgacttcccagaattattccgccaagcatcgtcatcccaatggaaaaatttctctgcagatgttaagttaacagatgatttctttatttccaacgagttgattgaagatgaaaacggcgaattaactgaggtggaaagagaacctggtgccaacgctattggtatggttgcctttaagattactgtaaagactcctgaatatccaagaggccgtcaatttgttgttgttgctaacgatatcacattcaagatcggttcctttggtccacaagaagacgaattcttcaataaggttactgaatatgctagaaagcgtggtatcccaagaatttacttggctgcaaactcaggtgccagaattggtatggctgaagagattgttccactatttcaagttgcatggaatgatgctgccaatccggacaagggcttccaatacttatacttaacaagtgaaggtatggaaactttaaagaaatttgacaaagaaaattctgttctcactgaacgtactgttataaacggtgaagaaagatttgtcatcaagacaattattggttctgaagatgggttaggtgtcgaatgtctacgtggatctggtttaattgctggtgcaacgtcaagggcttaccacgatatcttcactatcaccttagtcacttgtagatccgtcggtatcggtgcttatttggttcgtttgggtcaaagagctattcaggtcgaaggccagccaattattttaactggtgctcctgcaatcaacaaaatgctgggtagagaagtttatacttctaacttacaattgggtggtactcaaatcatgtataacaacggtgtttcacatttgactgctgttgacgatttagctggtgtagagaagattgttgaatggatgtcttatgttccagccaagcgtaatatgccagttcctatcttggaaactaaagacacatgggatagaccagttgatttcactccaactaatgatgaaacttacgatgtaagatggatgattgaaggtcgtgagactgaaagtggatttgaatatggtttgtttgataaagggtctttctttgaaactttgtcaggatgggccaaaggtgttgtcgttggtagagcccgtcttggtggtattccactgggtgttattggtgttgaaacaagaactgtcgagaacttgattcctgctgatccagctaatccaaatagtgctgaaacattaattcaagaacctggtcaagtttggcatccaaactccgccttcaagactgctcaagctatcaatgactttaacaacggtgaacaattgccaatgatgattttggccaactggagaggtttctctggtggtcaacgtgatatgttcaacgaagtcttgaagtatggttcgtttattgttgacgcattggtggattacaaacaaccaattattatctatatcccacctaccggtgaactaagaggtggttcatgggttgttgtcgatccaactatcaacgctgaccaaatggaaatgtatgccgacgtcaacgctagagctggtgttttggaaccacaaggtatggttggtatcaagttccgtagagaaaaattgctggacaccatgaacagattggatgacaagtacagagaattgagatctcaattatccaacaagagtttggctccagaagtacatcagcaaatatccaagcaattagctgatcgtgagagagaactattgccaatttacggacaaatcagtcttcaatttgctgatttgcacgataggtcttcacgtatggtggccaagggtgttatttctaaggaactggaatggaccgaggcacgtcgtttcttcttctggagattgagaagaagattgaacgaagaatatttgattaaaaggttgagccatcaggtaggcgaagcatcaagattagaaaagatcgcaagaattagatcgtggtaccctgcttcagtggaccatgaagatgataggcaagtcgcaacatggattgaagaaaactacaaaactttggacgataaactaaagggtttgaaattagagtcattcgctcaagacttagctaaaaagatcagaagcgaccatgacaatgctattgatggattatctgaagttatcaagatgttatctaccgatgataaagaaaaattgttgaagactttgaaataaaaattgtctggtggtggtggttctggtggtggtggttctggtggtggtggttctgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaatattatcaaaaagctttggaattggatccaaataatgctgaagcttggtataatttgggtaatgcttattataaacaaggtgattatcaaaaagctattgaagattatcaaaaagctttggaattggatccaaataatttgcaagctgaagcttggaaaaatttgggtaatgcttattataaacaaggtgattatcaaaaagctattgaatattatcaaaaagctttggaattggatccaaataatgcttctgcttggtataatttgggtaatgcttattataaacaaggtgattatcaaaaagctattgaatattatcaaaaagctttggaattggatccaaataatgctaaagcttggtatagaagaggtaatgcttattataaacaaggtgattatcaaaaagctattgaagattatcaaaaagctttggaattggatccaaataatagatctagatctgctggtggtggtggttctggtggtggtggttctggtggtggtggtgcttctggttctcatatgagattgggtgctcaatctattcaaccaactgctaatttggatagaactgatgatttggtttatttgaatgttatggaattggttagagctgttttggaattgaaaaatgaattggctcaattgccaccagaaggttatgttgttgttgttaaaaatgttggtttgactttgagaaaattgattggttctgttgatgatttgttgccatctttgccatcttcttctagaactgaaattgaaggtactcaaaaattgttgaataaagatttggctgaattgattaataaaatgagattggctcaacaaaatgctgttacttctttgtctgaagaatgtaaaagacaaatgttgactgcttctcatactttggctgttgatgctaaaaatttgttggatgctgttgatcaagctaaagttttggctaatttggctcatccaccagctgaaggttctgctggttctgctgctggttctggtgaatttggttctgctgaagctgctgctaaagaagctgctgctaaagctggttctgctggttctgctgctggttctggtgaatttggttctggtgctatggctactccaggttctgaaaatgttttgccaagagaaccattgattgctactgctgttaaatttttgcaaaattctagagttagacaatctccattggctactagaagagcttttttgaaaaaaaaaggtttgactgatgaagaaattgatatggcttttcaacaatctggtactgctgctgatgaaccatcttctttgtgg

SEQ ID NO: 158 - DNA, 10860 bp, Artificial Sequence
  encodes scaffold
atgggttctgctggttctgctgctggttctggtgaatttggttctgctggttctgctgctggttctggtgaatttggttctgctggttctgctgctggttctggtgaattttcttattatcatcatcatcatcatcatttggaatctacttctttgtataaaaaagctggttctggttctgctagaaatgcttatttgagaaaaaaaattgctagattgaaaaaagataatttgcaattggaaagagatgaacaaaatttggaaaaaattattgctaatttgagagatgaaattgctagattggaaaatgaagttgcttctcatgaacaaggttctgctggttctgctgctggttctggtgaatttgctgaagctgctgctaaagaagctgctgctaaagctggttctgctggttctgctgctggttctggtgaattttcttattatcatcatcatcatcatcatttggaatctacttctttgtataaaaaagctggttctggttctaatttggttgctcaattggaaaatgaagttgcttctttggaaaatgaaaatgaaactttgaaaaaaaaaaatttgcataaaaaagatttgattgcttatttggaaaaagaaattgctaatttgagaaaaaaaattgaagaaggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttcttcttattatcatcatcatcatcatcatttggaatctacttctttgtataaaaaagctggttctggttctcaaaaagttgctgaattgaaaaatagagttgctgttaaattgaatagaaatgaacaattgaaaaataaagttgaagaattgaaaaatagaaatgcttatttgaaaaatgaattggctactttggaaaatgaagttgctagattggaaaatgatgttgctgaaggttctgctggttctgctgctggttctggtgaatttgctgaagctgctgctaaagaagctgctgctaaagctggttctgctggttctgctgctggttctggtgaattttcttattatcatcatcatcatcatcatttggaatctacttctttgtataaaaaagctggttctggttctaatgaagttactactttggaaaatgatgctgcttttattgaaaatgaaaatgcttatttggaaaaagaaattgctagattgagaaaagaaaaagctgctttgagaaatagattggctcataaaaaaggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttctagaccaccaactatttctaatccaccaccattgatttcttctgctaaacatccatctgttggttctgctggttctgctgctggttctggtgaatttgctgaagctgctgctaaagaagctgctgctaaagctggttctgctggttctgctgctggttctggtgaatttaattttttgcaatctagaccagaaccaactgctccaccagaagaatcttttagatctggtggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttcttctaaaggtactggtttgaatccaaatgctaaagtttggcaagaaattgctccaggtaatggttctgctggttctgctgctggttctggtgaatttgctgaagctgctgctaaagaagctgctgctaaagctggttctgctggttctgctgctggttctggtgaatttccagatggtggtactacttttgaacatttgtggtcttctttggaaccagattctacttatggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttcttcttattatcatcatcatcatcatcatttggaatctacttctttgtataaaaaagctggttctggttctaaaagaattgcttatttgagaaaaaaaattgctgctttgaaaaaagataatgctaatttggaaaaagatattgctaatttggaaaatgaaattgaaagattgattaaagaaattaaaactttggaaaatgaagttgcttctcatgaacaaggttctgctggttctgctgctggttctggtgaatttgctgaagctgctgctaaagaagctgctgctaaagctggttctgctggttctgctgctggttctggtgaattttcttattatcatcatcatcatcatcatttggaatctacttctttgtataaaaaagctggttctggttctaatttgttggctactttgagatctactgctgctgttttggaaaatgaaaatcatgttttggaaaaagaaaaagaaaaattgagaaaagaaaaagaacaattgttgaataaattggaagcttataaaggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttctccagctacttctcaacatccaccaccaccaccaggtcatagatctcaagctccatctcatggttctgctggttctgctgctggttctggtgaatttgctgaagctgctgctaaagaagctgctgctaaagctggttctgctggttctgctgctggttctggtgaatttgaattgaattctttgttgattttgttggaagctgctgaatatttggaaagaagagatagaggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttctagaccaccaactatttctaatccaccaccattgatttcttctgctaaacatccatctgttggttctgctggttctgctgctggttctggtgaatttgctgaagctgctgctaaagaagctgctgctaaagctggttctgctggttctgctgctggttctggtgaatttaattttttgcaatctagaccagaaccaactgctccaccagaagaatcttttagatctggtggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttcttctaaaggtactggtttgaatccaaatgctaaagtttggcaagaaattgctccaggtaatggttctgctggttctgctgctggttctggtgaatttgctgaagctgctgctaaagaagctgctgctaaagctggttctgctggttctgctgctggttctggtgaatttccagatggtggtactacttttgaacatttgtggtcttctttggaaccagattctacttatggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttcttcttattatcatcatcatcatcatcatttggaatctacttctttgtataaaaaagctggttctggttctaaaagaattgcttatttgagaaaaaaaattgctgctttgaaaaaagataatgctaatttggaaaaagatattgctaatttggaaaatgaaattgaaagattgattaaagaaattaaaactttggaaaatgaagttgcttctcatgaacaaggttctgctggttctgctgctggttctggtgaatttgctgaagctgctgctaaagaagctgctgctaaagctggttctgctggttctgctgctggttctggtgaattttcttattatcatcatcatcatcatcatttggaatctacttctttgtataaaaaagctggttctggttctaatttgttggctactttgagatctactgctgctgttttggaaaatgaaaatcatgttttggaaaaagaaaaagaaaaattgagaaaagaaaaagaacaattgttgaataaattggaagcttataaaggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttctgctttggttgatgatgctgctgattatgaaccaccaccatctaataatgaagaagctttgggttctgctggttctgctgctggttctggtgaatttgctgaagctgctgctaaagaagctgctgctaaagctggttctgctggttctgctgctggttctggtgaatttagagaattgtttgatgatccatcttatgttaatgttcaaaatttggataaagctagacaaggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttctaaaaatactaaatctatgaattttgataatccagtttatagaaaaactactgaagaagaaggttctgctggttctgctgctggttctggtgaatttgctgaagctgctgctaaagaagctgctgctaaagctggttctgctggttctgctgctggttctggtgaatttagatctttgccatctacttggattgaaaataaattgtatggtatgtctgatccaaattggggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttctgttgttgataattctccaccaccagctttgccaccaaaaaaaagacaatctgctccatctggttctgctggttctgctgctggttctggtgaatttgctgaagctgctgctaaagaagctgctgctaaagctggttctgctggttctgctgctggttctggtgaatttactcaaagatctaaaccacaaccagctgttccaccaagaccatctgctgatttgattttgggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttctactgatgaagaaagagaagaaactgaagaagaagtttatttgttgaattctactactttgggttctgctggttctgctgctggttctggtgaatttgctgaagctgctgctaaagaagctgctgctaaagctggttctgctggttctgctgctggttctggtgaatttgatggtaatgtttctggtactcaaagattggattctgctactgttagaacttattcttgtggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttcttcttattatcatcatcatcatcatcatttggaatctacttctttgtataaaaaagctggttctggttctcaaaaagttgctcaattgaaaaatagagttgcttataaattgaaagaaaatgctaaattggaaaatattgttgctagattggaaaatgataatgctaatttggaaaaagatattgctaatttggaaaaagatattgctaatttggaaagagatgttgctagaggttctgctggttctgctgctggttctggtgaatttgctgaagctgctgctaaagaagctgctgctaaagctggttctgctggttctgctgctggttctggtgaattttcttattatcatcatcatcatcatcatttggaatctacttctttgtataaaaaagctggttctggttctaatactgttaaagaattgaaaaattatattcaagaattggaagaaagaaatgctgaattgaaaaatttgaaagaacatttgaaatttgctaaagctgaattggaatttgaattggctgctcataaatttgaaggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttctcatgatgattctttgccacatccacaacaagctactgatgattctggtcatgaatctgatggttctgctggttctgctgctggttctggtgaatttgctgaagctgctgctaaagaagctgctgctaaagctggttctgctggttctgctgctggttctggtgaatttggttctccaaatgctggttctgttgaacaaactccaaaaaaaccaggtttgagaagaagaggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttcttcttattatcatcatcatcatcatcatttggaatctacttctttgtataaaaaagctggttctggttcttttgaaaatgttactcatgaatttattttggctactttggaaaatgaaaatgctaaattgagaagattggaagctaaattggaaagagaattggctagattgagaaatgaagttgcttggttgggttctgctggttctgctgctggttctggtgaatttgctgaagctgctgctaaagaagctgctgctaaagctggttctgctggttctgctgctggttctggtgaattttcttattatcatcatcatcatcatcatttggaatctacttctttgtataaaaaagctggttctggttctcaaaaagttgaagaattgaaaaataaaattgctgaattggaaaatagaaatgctgttaaaaaaaatagagttgctcatttgaaacaagaaattgcttatttgaaagatgaattggctgctcatgaatttgaaggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttctgtttcttctactaaattggtttcttttcatgatgattctgatgaagatttgttgcatattggttctgctggttctgctgctggttctggtgaatttgctgaagctgctgctaaagaagctgctgctaaagctggttctgctggttctgctgctggttctggtgaatttgctgctgctactccaatttctacttttcatgatgattctgatgaagatttgttgcatgttggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttcttcttattatcatcatcatcatcatcatttggaatctacttctttgtataaaaaagctggttctggttctcaaaaagttgaatctttgaaacaaaaaattgaagaattgaaacaaagaaaagctcaattgaaaaatgatattgctaatttggaaaaagaaattgcttatgctgaaactggttctgctggttctgctgctggttctggtgaatttgctgaagctgctgctaaagaagctgctgctaaagctggttctgctggttctgctgctggttctggtgaattttcttattatcatcatcatcatcatcatttggaatctacttctttgtataaaaaagctggttctgaattttttagaagagaaagaaataaaatggctgctgctaaatgtagaaatagaagaagagaattgactgatactttgcaagctgaaactgatcaattggaagatgaaaaatctgctttgcaaactgaaattgctaatttgttgaaagaaaaagaaaaattggaatttattttggctgctcatagaccagcttgtaaaattccagatgatttgggttttccagaagaaatgtctttggaaggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttcttttcaaatgccagctgatactccaccaccagcttatttgccaccagaagatccaatgactggttctgctggttctgctgctggttctggtgaatttgctgaagctgctgctaaagaagctgctgctaaagctggttctgctggttctgctgctggttctggtgaatttgaaagagaatctaatgaagaaccaccaccaccatatgaagatccatattggggtaatggtggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttcttcttattatcatcatcatcatcatcatttggaatctacttctttgtataaaaaagctggttctggttctcaaaaagttgctgaattgaaaaatagagttgctgttaaattgaatagaaatgaacaattgaaaaataaagttgaagaattgaaaaatagaaatgcttatttgaaaaatgaattggctactttggaaaatgaagttgctagattggaaaatgatgttgctgaaggttctgctggttctgctgctggttctggtgaatttgctgaagctgctgctaaagaagctgctgctaaagctggttctgctggttctgctgctggttctggtgaattttcttattatcatcatcatcatcatcatttggaatctacttctttgtataaaaaagctggttctggttctaatgaagttactactttggaaaatgatgctgcttttattgaaaatgaaaatgcttatttggaaaaagaaattgctagattgagaaaagaaaaagctgctttgagaaatagattggctcataaaaaatcttattatcatcatcatcatcatcatttggaatctacttctttgtataaaaaagctggttctggttctgctagaaatgcttatttgagaaaaaaaattgctagattgaaaaaagataatttgcaattggaaagagatgaacaaaatttggaaaaaattattgctaatttgagagatgaaattgctagattggaaaatgaagttgcttctcatgaacaaggttctgctggttctgctgctggttctggtgaatttgctgaagctgctgctaaagaagctgctgctaaagctggttctgctggttctgctgctggttctggtgaattttcttattatcatcatcatcatcatcatttggaatctacttctttgtataaaaaagctggttctggttctaatttggttgctcaattggaaaatgaagttgcttctttggaaaatgaaaatgaaactttgaaaaaaaaaaatttgcataaaaaagatttgattgcttatttggaaaaagaaattgctaatttgagaaaaaaaattgaagaaggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttctgaacaaaaattgatttctgaagaagatttggaacaaaaattgatttctgaagaagatttggaacaaaaattgatttctgaagaagatttgggttctgctggttctgctgctggttctggtgaatttggttctgctggttctgctgctggttctggtgaatttggttctgctggttctgctgctggttctggtgaattt

SEQ ID NO: 159 - DNA, 1356 bp, Artificial Sequence
  encodes scaffold
atgggttctgctggttctgctgctggttctggtgaatttggttctgctggttctgctgctggttctggtgaatttggttctgctggttctgctgctggttctggtgaattttcttattatcatcatcatcatcatcatttggaatctacttctttgtataaaaaagctggttctggttctgctagaaatgcttatttgagaaaaaaaattgctagattgaaaaaagataatttgcaattggaaagagatgaacaaaatttggaaaaaattattgctaatttgagagatgaaattgctagattggaaaatgaagttgcttctcatgaacaaggttctgctggttctgctgctggttctggtgaatttgctgaagctgctgctaaagaagctgctgctaaagctggttctgctggttctgctgctggttctggtgaattttcttattatcatcatcatcatcatcatttggaatctacttctttgtataaaaaagctggttctggttctaatttggttgctcaattggaaaatgaagttgcttctttggaaaatgaaaatgaaactttgaaaaaaaaaaatttgcataaaaaagatttgattgcttatttggaaaaagaaattgctaatttgagaaaaaaaattgaagaaggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttcttctgctactagagaattggatgaattgatggcttctttgtctgattttaaaattcaaggtggttctgctggttctgctgctggttctggtgaatttgctgaagctgctgctaaagaagctgctgctaaagctggttctgctggttctgctgctggttctggtgaatttgatttggctttgtctgaaaattgggctcaagaatttttggctgctggtgatgctgttgatggttctgctggttctgctgctggttctggtgaatttggttctgctgaagctgctgctaaagaagctgctgctaaagaagctgctgctaaagaagctgctgctaaagctggttctgctggttctgctgctggttctggtgaatttggttctgattataaagatgatgatgataaagattataaagatgatgatgataaagattataaagatgatgatgataaaggttctgctggttctgctgctggttctggtgaatttggttctgctggttctgctgctggttctggtgaatttggttctgctggttctgctgctggttctggtgaattt

SEQ ID NO: 160 - protein, 1532 aa, Artificial Sequence
  chimeric enzymes
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSMKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASSYYHHHHHHLESTSLYKKAGSGSNLVAQLENEVASLENENETLKKKNLHKKDLIAYLEKEIANLRKKIEEGSAGSAAGSGEFGSAEAAAKEAAAKAGSAGSAAGSGEFGSSYYHHHHHHLESTSLYKKAGSGSARNAYLRKKIARLKKDNLQLERDEQNLEKIIANLRDEIARLENEVASHEQGSG

SEQ ID NO: 161 - protein, 824 aa, Artificial Sequence
  chimeric enzymes
MKNCVIVSAVRTAIGSFNGSLASTSAIDLGATVIKAAIERAKIDSQHVDEVIMGNVLQAGLGQNPARQALLKSGLAETVCGFTVNKVCGSGLKSVALAAQAIQAGQAQSIVAGGMENMSLAPYLLDAKARSGYRLGDGQVYDVILRDGLMCATHGYHMGITAENVAKEYGITREMQDELALHSQRKAAAAIESGAFTAEIVPVNVVTRKKTFVFSQDEFPKANSTAEALGALRPAFDKAGTVTAGNASGINDGAAALVIMEESAALAAGLTPLARIKSYASGGVPPALMGMGPVPATQKALQLAGLQLADIDLIEANEAFAAQFLAVGKNLGFDSEKVNVNGGAIALGHPIGASGARILVTLLHAMQARDKTLGLATLCIGGGQGIAMVIERLNKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASSYYHHHHHHLESTSLYKKAGSGSNEVTTLENDAAFIENENAYLEKEIARLRKEKAALRNRLAHKKGSAGSAAGSGEFGSAEAAAKEAAAKAGSAGSAAGSGEFGSSYYHHHHHHLESTSLYKKAGSGSQKVAELKNRVAVKLNRNEQLKNKVEELKNRNAYLKNELATLENEVARLENDVAEGSG

SEQ ID NO: 162 - protein, 779 aa, Artificial Sequence
  chimeric enzymes
MKKVCVIGAGTMGSGIAQAFAAKGFEVVLRDIKDEFVDRGLDFINKNLSKLVKKGKIEEATKVEILTRISGTVDLNMAADCDLVIEAAVERMDIKKQIFADLDNICKPETILASNTSSLSITEVASATKRPDKVIGMHFFNPAPVMKLVEVIRGIATSQETFDAVKETSIAIGKDPVEVAEAPGFVVNRILIPMINEAVGILAEGIASVEDIDKAMKLGANHPMGPLELGDFIGLDICLAIMDVLYSETGDSKYRPHTLLKKYVRAGWLGRKSGKGFYDYSKKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASENLYFQGENLYFQGDSSESCWNCGRKASETCSGCNTARYCGSFCQHKDWEKHHHICGQTLQAQQGSAGSAAGSGEFGSAEAAAKEAAAKAGSAGSAAGSGEFGSMAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPGSG

SEQ ID NO: 163 - protein, 744 aa, Artificial Sequence
  chimeric enzymes
MELNNVILEKEGKVAVVTINRPKALNALNSDTLKEMDYVIGEIENDSEVLAVILTGAGEKSFVAGADISEMKEMNTIEGRKFGILGNKVFRRLELLEKPVIAAVNGFALGGGCEIAMSCDIRIASSNARFGQPEVGLGITPGFGGTQRLSRLVGMGMAKQLIFTAQNIKADEALRIGLVNKVVEPSELMNTAKEIANKIVSNAPVAVKLSKQAINRGMQCDIDTALAFESEAFGECFSTEDQKDAMTAFIEKRKIEGFKNRKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASGPLGSPLTASMLASAPPQEQKQMLGERLFPLIQAMHPTLAGKITGMLLEIDNSELLHMLESPESLRSKVDEAVAVLQAHQAKEAAQKAGSAGSAAGSGEFGSAEAAAKEAAAKAGSAGSAAGSGEFGSNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVGSG

SEQ ID NO: 164 - protein, 823 aa, Artificial Sequence
  chimeric enzymes
MIVKPMVRNNICLNAHPQGCKKGVEDQIEYTKKRITAEVKAGAKAPKNVLVLGCSNGYGLASRITAAFGYGAATIGVSFEKAGSETKYGTPGWYNNLAFDEAAKREGLYSVTIDGDAFSDEIKAQVIEEAKKKGIKFDLIVYSLASPVRTDPDTGIMHKSVLKPFGKTFTGKTVDPFTGELKEISAEPANDEEAAATVKVMGGEDWERWIKQLSKEGLLEEGCITLAYSYIGPEATQALYRKGTIGKAKEHLEATAHRLNKENPSIRAFVSVNKGLVTRASAVIPVIPLYLASLFKVMKEKGNHEGCIEQITRLYAERLYRKDGTIPVDEENRIRIDDWELEEDVQKAVSALMEKVTGENAESLTDLAGYRHDFLASNGFDVEGINYEAEVERFDRIKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASSYYHHHHHHLESTSLYKKAGSGSNLLATLRSTAAVLENENHVLEKEKEKLRKEKEQLLNKLEAYKGSAGSAAGSGEFGSAEAAAKEAAAKAGSAGSAAGSGEFGSSYYHHHHHHLESTSLYKKAGSGSKRIAYLRKKIAALKKDNANLEKDIANLENEIERLIKEIKTLENEVASHEQGSG

SEQ ID NO: 165 - protein, 829 aa, Artificial Sequence
  chimeric enzymes
MTREVVVVSGVRTAIGTFGGSLKDVAPAELGALVVREALARAQVSGDDVGHVVFGNVIQTEPRDMYLGRVAAVNGGVTINAPALTVNRLCGSGLQAIVSAAQTILLGDTDVAIGGGAESMSRAPYLAPAARWGARMGDAGLVDMMLGALHDPFHRIHMGVTAENVAKEYDISRAQQDEAALESHRRASAAIKAGYFKDQIVPVVSKGRKGDVTFDTDEHVRHDATIDDMTKLRPVFVKENGTVTAGNASGLNDAAAAVVMMERAEAERRGLKPLARLVSYGHAGVDPKAMGIGPVPATKIALERAGLQVSDLDVIEANEAFAAQACAVTKALGLDPAKVNPNGSGISLGHPIGATGALITVKALHELNRVQGRYALVTMCIGGGQGIAAIFERIKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASDVMWEYKWENTGDAELYGPFTSAQMQTWVSEGYFPDGVYCRKLDPPGGQFYNSKRIDFDLYTGSAGSAAGSGEFGSAEAAAKEAAAKAGSAGSAAGSGEFGSESDSVEFNNAISYVNKIKTRFLDHPEIYRSFLEILHTYQKEQLHTKGRPFRGMSEEEVFTEVANLFRGQEDLLSEFGQFLPEAKRGSG

SEQ ID NO: 166 - protein, 852 aa, Artificial Sequence
  chimeric enzyme
MKLSTKLCWCGIKGRLRPQKQQQLHNTNLQMTELKKQKTAEQKTRPQNVGIKGIQIYIPTQCVNQSELEKFDGVSQGKYTIGLGQTNMSFVNDREDIYSMSLTVLSKLIKSYNIDTNKIGRLEVGTETLIDKSKSVKSVLMQLFGENTDVEGIDTLNACYGGTNALFNSLNWIESNAWDGRDAIVVCGDIAIYDKGAARPTGGAGTVAMWIGPDAPIVFDSVRASYMEHAYDFYKPDFTSEYPYVDGHFSLTCYVKALDQVYKSYSKKAISKGLVSDPAGSDALNVLKYFDYNVFHVPTCKLVTKSYGRLLYNDFRANPQLFPEVDAELATRDYDESLTDKNIEKTFVNVAKPFHKERVAQSLIVPTNTGNMYTASVYAAFASLLNYVGSDDLQGKRVGLFSYGSGLAASLYSCKIVGDVQHIIKELDITNKLAKRITETPKDYEAAIELRENAHLKKNFKPQGSIEHLQSGVYYLTNIDDKFRRSYDVKKKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASLGPLPPGWEVRSTVSGRIYFVDHNNRTTQFTDPRLHGSAGSAAGSGEFGSAEAAAKEAAAKAGSAGSAAGSGEFGSGAMGPLPPGWEKRTDSNGRVYFVNHNTRITQWEDPRSGSG

SEQ ID NO: 167 - protein, 829 aa, Artificial Sequence
  chimeric enzyme
MVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASSYYHHHHHHLESTSLYKKAGSEFFRRERNKMAAAKCRNRRRELTDTLQAETDQLEDEKSALQTEIANLLKEKEKLEFILAAHRPACKIPDDLGFPEEMSLEGSAGSAAGSGEFGSAEAAAKEAAAKAGSAGSAAGSGEFGSSYYHHHHHHLESTSLYKKAGSGSQKVESLKQKIEELKQRKAQLKNDIANLEKEIAYAETGSG

SEQ ID NO: 168 - protein, 1049 aa, Artificial Sequence
  chimeric enzyme
MSLPFLTSAPGKVIIFGEHSAVYNKPAVAASVSALRTYLLISESSAPDTIELDFPDISFNHKWSINDFNAITEDQVNSQKLAKAQQATDGLSQELVSLLDPLLAQLSESFHYHAAFCFLYMFVCLCPHAKNIKFSLKSTLPIGAGLGSSASISVSLALAMAYLGGLIGSNDLEKLSENDKHIVNQWAFIGEKCIHGTPSGIDNAVATYGNALLFEKDSHNGTINTNNFKFLDDFPAIPMILTYTRIPRSTKDLVARVRVLVTEKFPEVMKPILDAMGECALQGLEIMTKLSKCKGTDDEAVETNNELYEQLLELIRINHGLLVSIGVSHPGLELIKNLSDDLRIGSTKLTGAGGGGCSLTLLRRDITQEQIDSFKKKLQDDFSYETFETDLGGTGCCLLSAKNLNKDLKIKSLVFQLFENKTTTKQQIDDLLLPGNTNLPWTSKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASMEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSGSAGSAAGSGEFGSAEAAAKEAAAKAGSAGSAAGSGEFGSGAMGSMAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQGIVQSDPPIPVDRTLIPSPPPRPKNGSG

SEQ ID NO: 169 - protein, 871 aa, Artificial Sequence
  chimeric enzyme
MSELRAFSAPGKALLAGGYLVLDTKYEAFVVGLSARMHAVAHPYGSLQGSDKFEVRVKSKQFKDGEWLYHISPKSGFIPVSIGGSKNPFIEKVIANVFSYFKPNMDDYCNRNLFVIDIFSDDAYHSQEDSVTEHRGNRRLSFHSHRIEEVPKTGLGSSAGGLVTVLTTALASFFVSDLENNVDKYREVIHNLAQVAHCQAQGKIGSGFDVAAAAYGSIRYRRFPPALISNLPDIGSATYGSKLAHLVDEEDWNITIKSNHLPSGLTLWMGDIKNGSETVKLVQKVKNWYDSHMPESLKIYTELDHANSRFMDGLSKLDRLHETHDDYSDQIFESLERNDCTCQKYPEITEVRDAVATIRRSFRKITKESGADIEPPVQTSLLDDCQTLKGVLTCLIPGAGGYDAIAVITKQDVDLRAQTANDKRFSKVQWLDVTQADWGVRKEKDPETYLDKKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASSYYHHHHHHLESTSLYKKAGSGSQKVEELKNKIAELENRNAVKKNRVAHLKQEIAYLKDELAAHEFEGSAGSAAGSGEFGSAEAAAKEAAAKAGSAGSAAGSGEFGSSYYHHHHHHLESTSLYKKAGSGSFENVTHEFILATLENENAKLRRLEAKLERELARLRNEVAWLGSG

SEQ ID NO: 170 - protein, 1011 aa, Artificial Sequence
  chimeric enzyme
MTVYTASVTAPVNIATLKYWGKRDTKLNLPTNSSISVTLSQDDLRTLTSAATAPEFERDTLWLNGEPHSIDNERTQNCLRDLRQLRKEMESKDASLPTLSQWKLHIVSENNFPTAAGLASSAAGFAALVSAIAKLYQLPQSTSEISRIARKGSGSACRSLFGGYVAWEMGKAEDGHDSMAVQIADSSDWPQMKACVLVVSDIKKDVSSTQGMQLTVATSELFKERIEHVVPKRFEVMRKAIVEKDFATFAKETMMDSNSFHATCLDSFPPIFYMNDTSKRIISWCHTINQFYGETIVAYTFDAGPNAVLYYLAENESKLFAFIYKLFGSVPGWDKKFTTEQLEAFNHQFESSNFTARELDLELQKDVARVILTQVGSGPQETNESLIDAKTGLPKEKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASAMADLEQKVLEMEASTYDGVFIWKISDFPRKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGLGSAGSAAGSGEFGSAEAAAKEAAAKAGSAGSAAGSGEFGSASIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVRKENQWCGSG

SEQ ID NO: 171 - protein, 720 aa, Artificial Sequence
  chimeric enzyme
MTADNNSMPHGAVSSYAKLVQNQTPEDILEEFPEIIPLQQRPNTRSSETSNDESGETCFSGHDEEQIKLMNENCIVLDWDDNAIGAGTKKVCHLMENIEKGLLHRAFSVFIFNEQGELLLQQRATEKITFPDLWTNTCCSHPLCIDDELGLKGKLDDKIKGAITAAVRKLDHELGIPEDETKTRGKFHFLNRIHYMAPSNEPWGEHEIDYILFYKINAKENLTVNPNVNEVRDFKWVSPNDLKTMFADPSYKFTPWFKIICENYLFNWWEQLDDLSEVENDRQIHRMLKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASSYYHHHHHHLESTSLYKKAGSGSNTVKELKNYIQELEERNAELKNLKEHLKFAKAELEFELAAHKFEGSAGSAAGSGEFGSAEAAAKEAAAKAGSAGSAAGSGEFGSSYYHHHHHHLESTSLYKKAGSGSQKVAQLKNRVAYKLKENAKLENIVARLENDNANLEKDIANLEKDIANLERDVARGSG

SEQ ID NO: 172 - protein, 801 aa, Artificial Sequence
  chimeric enzyme
MEAKIDELINNDPVWSSQNESLISKPYNHILLKPGKNFRLNLIVQINRVMNLPKDQLAIVSQIVELLHNSSLLIDDIEDNAPLRRGQTTSHLIWGVPSTINTANYMYFRAMQLVSQLTTKEPLYHWLITIFNEELINLHRGQGLDIYWRDFLPEIIPTQEMYLNMVMNKTGGLFRLTLRLMEALSPSSHHGHSLVPFINLLGIIYQIRDDYLNLKDFQMSSEKGFAEDITEGKLSFPIVHALNFTKTKGQTEQHNEILRILLLRTSDKDIKLKLIQILEFDTNSLAYTKNFINQLVNMIKNDNENKYLPDLASHSDTATNLHDELLYIIDHLSELKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASLCTMKKGPSGYGFNLHSDKSKPGQFIRSVDPDSPAEASGLRAQDRIVEVNGVCMEGKQHGDVVSAIRAGGDETKLLVVDREGSAGSAAGSGEFGSAEAAAKEAAAKAGSAGSAAGSGEFGSSSGAIIYTVELKRYGGPLGITISGTEEPFDPIIISSLTKGGLAERTGAIHIGDRILAINSSSLKGKPLSEAIHLLQMAGETVTLKIKKQTDAQPASSGSG

SEQ ID NO: 173 - protein, 547 aa, Artificial Sequence
  chimeric enzyme
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHGSG

SEQ ID NO: 174 - protein, 548 aa, Artificial Sequence
  chimeric enzyme
MNCSTFSFWFVCKIIFFFLSFNIQISIANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAACKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPRHHGSG

SEQ ID NO: 175 - protein, 886 aa, Artificial Sequence
  chimeric enzyme
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKYKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASGNNLETYEWYNKSISRDKAEKLLLDTGKEGAFMVRDSRTPGTYTVSVFTKAIISENPCIKHYHIKETNDSPKRYYVAEKYVFDSIPLLIQYHQYNGGGLVTRLRYPVCGGSAGSAAGSGEFGSAEAAAKEAAAKAGSAGSAAGSGEFGSGSHPWFFGKIPRAKAEEMLSKQRHDGAFLIRESESAPGDFSLSVKFGNDVQHFKVLRDGAGKYFLWVVKFNSLNELVDYHRSTSVSRNQQIFLRDIEQVPQQPTGSG

SEQ ID NO: 176 - protein, 668 aa, Artificial Sequence
  chimeric enzyme
MAVKHLIVLKFKDEITEAQKEEFFKTYVNLVNIIPAMKDVYWGKDVTQKNKEEGYTHIVEVTFESVETIQDYIIHPAHVGFGDVYRSFWEKLLIFDYTPRKKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAGSAGSAAGSGEFGSAEAAAKEAAAKAGSAGSAAGSGEFGSGSHMGSQFWVTSQKTEASERCGLQGSYILRVEAEKLTLLTLGAQSQILEPLLFWPYTLLRRYGRDKVMFSFEAGRRCPSGPGTFTFQTSQGNDIFQAVEAAIQQQKAQGKVGQAQDILRLEHHHHHHGSG

SEQ ID NO: 177 - protein, 800 aa, Artificial Sequence
  chimeric enzyme
MGLSSVCTFSFQTNYHTLLNPHNNNPKTSLLCYRHPKTPIKYSYNNFPSKHCSTKSFHLQNKCSESLSIAKNSIRAATTNQTEPPESDNHSVATKILNFGKACWKLQRPYTIIAFTSCACGLFGKELLHNTNLISWSLMFKAFFFLVAILCIASFTTTINQIYDLHIDRINKPDLPLASGEISVNTAWIMSIIVALFGLIITIKMKGGPLYIFGYCFGIFGGIVYSVPPFRWKQNPSTAFLLNFLAHIITNFTFYYASRAALGLPFELRPSFTFLLAFMKSMGSALALIKDASDVEGDTKFGISTLASKYGSRNLTLFCSGIVLLSYVAAILAGIIWPQAFNSNVMLLSHAILAFWLILQTRDFALTNYDPEAGRRFYEFMWKLYYAEYLVYVFIKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASAEYVRALFDFNGNDEEDLPFKKGDILRIRDKPEEQWWNAEDSEGKRGMIPVPYVEKYGSAGSAAGSGEFGSAEAAAKEAAAKAGSAGSAAGSGEFGSLIKHMRAEALFDFTGNSKLELNFKAGDVIFLLSRINKDWLEGTVRGATGIFPLSFVKILKGSG

SEQ ID NO: 178 - protein, 2744 aa, Artificial Sequence
  chimeric enzyme
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLSDGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVSVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLKKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASGSHMRLGAQSIQPTANLDRTDDLVYLNVMELVRAVLELKNELAQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAEGSAGSAAGSGEFGSAEAAAKEAAAKAGSAGSAAGSGEFGSGAMATPGSENVLPREPLIATAVKFLQNSRVRQSPLATRRAFLKKKGLTDEEIDMAFQQSGTAADEPSSLWGSG

SEQ ID NO: 179 - protein, 3623 aa, Artificial Sequence
  scaffold polypeptide
MGSAGSAAGSGEFGSAGSAAGSGEFGSAGSAAGSGEFSYYHHHHHHLESTSLYKKAGSGSARNAYLRKKIARLKKDNLQLERDEQNLEKIIANLRDEIARLENEVASHEQGSAGSAAGSGEFAEAAAKEAAAKAGSAGSAAGSGEFSYYHHHHHHLESTSLYKKAGSGSNLVAQLENEVASLENENETLKKKNLHKKDLIAYLEKEIANLRKKIEEGSAGSAAGSGEFGSAEAAAKEAAAKEAAAKEAAAKAGSAGSAAGSGEFGSSYYHHHHHHLESTSLYKKAGSGSQKVAELKNRVAVKLNRNEQLKNKVEELKNRNAYLKNELATLENEVARLENDVAEGSAGSAAGSGEFAEAAAKEAAAKAGSAGSAAGSGEFSYYHHHHHHLESTSLYKKAGSGSNEVTTLENDAAFIENENAYLEKEIARLRKEKAALRNRLAHKKGSAGSAAGSGEFGSAEAAAKEAAAKEAAAKEAAAKAGSAGSAAGSGEFGSRPPTISNPPPLISSAKHPSVGSAGSAAGSGEFAEAAAKEAAAKAGSAGSAAGSGEFNFLQSRPEPTAPPEESFRSGGSAGSAAGSGEFGSAEAAAKEAAAKEAAAKEAAAKAGSAGSAAGSGEFGSSKGTGLNPNAKVWQEIAPGNGSAGSAAGSGEFAEAAAKEAAAKAGSAGSAAGSGEFPDGGTTFEHLWSSLEPDSTYGSAGSAAGSGEFGSAEAAAKEAAAKEAAAKEAAAKAGSAGSAAGSGEFGSSYYHHHHHHLESTSLYKKAGSGSKRIAYLRKKIAALKKDNANLEKDIANLENEIERLIKEIKTLENEVASHEQGSAGSAAGSGEFAEAAAKEAAAKAGSAGSAAGSGEFSYYHHHHHHLESTSLYKKAGSGSNLLATLRSTAAVLENENHVLEKEKEKLRKEKEQLLNKLEAYKGSAGSAAGSGEFGSAEAAAKEAAAKEAAAKEAAAKAGSAGSAAGSGEFGSPATSQHPPPPPGHRSQAPSHGSAGSAAGSGEFAEAAAKEAAAKAGSAGSAAGSGEFELNSLLILLEAAEYLERRDRGSAGSAAGSGEFGSAEAAAKEAAAKEAAAKEAAAKAGSAGSAAGSGEFGSRPPTISNPPPLISSAKHPSVGSAGSAAGSGEFAEAAAKEAAAKAGSAGSAAGSGEFNFLQSRPEPTAPPEESFRSGGSAGSAAGSGEFGSAEAAAKEAAAKEAAAKEAAAKAGSAGSAAGSGEFGSSKGTGLNPNAKVWQEIAPGNGSAGSAAGSGEFAEAAAKEAAAKAGSAGSAAGSGEFPDGGTTFEHLWSSLEPDSTYGSAGSAAGSGEFGSAEAAAKEAAAKEAAAKEAAAKAGSAGSAAGSGEFGSSYYHHHHHHLESTSLYKKAGSGSKRIAYLRKKIAALKKDNANLEKDIANLENEIERLIKEIKTLENEVASHEQGSAGSAAGSGEFAEAAAKEAAAKAGSAGSAAGSGEFSYYHHHHHHLESTSLYKKAGSGSNLLATLRSTAAVLENENHVLEKEKEKLRKEKEQLLNKLEAYKGSAGSAAGSGEFGSAEAAAKEAAAKEAAAKEAAAKAGSAGSAAGSGEFGSALVDDAADYEPPPSNNEEALGSAGSAAGSGEFAEAAAKEAAAKAGSAGSAAGSGEFRELFDDPSYVNVQNLDKARQGSAGSAAGSGEFGSAEAAAKEAAAKEAAAKEAAAKAGSAGSAAGSGEFGSKNTKSMNFDNPVYRKTTEEEGSAGSAAGSGEFAEAAAKEAAAKAGSAGSAAGSGEFRSLPSTWIENKLYGMSDPNWGSAGSAAGSGEFGSAEAAAKEAAAKEAAAKEAAAKAGSAGSAAGSGEFGSVVDNSPPPALPPKKRQSAPSGSAGSAAGSGEFAEAAAKEAAAKAGSAGSAAGSGEFTQRSKPQPAVPPRPSADLILGSAGSAAGSGEFGSAEAAAKEAAAKEAAAKEAAAKAGSAGSAAGSGEFGSTDEEREETEEEVYLLNSTTLGSAGSAAGSGEFAEAAAKEAAAKAGSAGSAAGSGEFDGNVSGTQRLDSATVRTYSCGSAGSAAGSGEFGSAEAAAKEAAAKEAAAKEAAAKAGSAGSAAGSGEFGSSYYHHHHHHLESTSLYKKAGSGSQKVAQLKNRVAYKLKENAKLENIVARLENDNANLEKDIANLEKDIANLERDVARGSAGSAAGSGEFAEAAAKEAAAKAGSAGSAAGSGEFSYYHHHHHHLESTSLYKKAGSGSNTVKELKNYIQELEERNAELKNLKEHLKFAKAELEFELAAHKFEGSAGSAAGSGEFGSAEAAAKEAAAKEAAAKEAAAKAGSAGSAAGSGEFGSHDDSLPHPQQATDDSGHESDGSAGSAAGSGEFAEAAAKEAAAKAGSAGSAAGSGEFGSPNAGSVEQTPKKPGLRRRGSAGSAAGSGEFGSAEAAAKEAAAKEAAAKEAAAKAGSAGSAAGSGEFGSSYYHHHHHHLESTSLYKKAGSGSFENVTHEFILATLENENAKLRRLEAKLERELARLRNEVAWLGSAGSAAGSGEFAEAAAKEAAAKAGSAGSAAGSGEFSYYHHHHHHLESTSLYKKAGSGSQKVEELKNKIAELENRNAVKKNRVAHLKQEIAYLKDELAAHEFEGSAGSAAGSGEFGSAEAAAKEAAAKEAAAKEAAAKAGSAGSAAGSGEFGSVSSTKLVSFHDDSDEDLLHIGSAGSAAGSGEFAEAAAKEAAAKAGSAGSAAGSGEFAAATPISTFHDDSDEDLLHVGSAGSAAGSGEFGSAEAAAKEAAAKEAAAKEAAAKAGSAGSAAGSGEFGSSYYHHHHHHLESTSLYKKAGSGSQKVESLKQKIEELKQRKAQLKNDIANLEKEIAYAETGSAGSAAGSGEFAEAAAKEAAAKAGSAGSAAGSGEFSYYHHHHHHLESTSLYKKAGSEFFRRERNKMAAAKCRNRRRELTDTLQAETDQLEDEKSALQTEIANLLKEKEKLEFILAAHRPACKIPDDLGFPEEMSLEGSAGSAAGSGEFGSAEAAAKEAAAKEAAAKEAAAKAGSAGSAAGSGEFGSFQMPADTPPPAYLPPEDPMTGSAGSAAGSGEFAEAAAKEAAAKAGSAGSAAGSGEFERESNEEPPPPYEDPYWGNGGSAGSAAGSGEFGSAEAAAKEAAAKEAAAKEAAAKAGSAGSAAGSGEFGSSYYHHHHHHLESTSLYKKAGSGSQKVAELKNRVAVKLNRNEQLKNKVEELKNRNAYLKNELATLENEVARLENDVAEGSAGSAAGSGEFAEAAAKEAAAKAGSAGSAAGSGEFSYYHHHHHHLESTSLYKKAGSGSNEVTTLENDAAFIENENAYLEKEIARLRKEKAALRNRLAHKKSYYHHHHHHLESTSLYKKAGSGSARNAYLRKKIARLKKDNLQLERDEQNLEKIIANLRDEIARLENEVASHEQGSAGSAAGSGEFAEAAAKEAAAKAGSAGSAAGSGEFSYYHHHHHHLESTSLYKKAGSGSNLVAQLENEVASLENENETLKKKNLHKKDLIAYLEKEIANLRKKIEEGSAGSAAGSGEFGSAEAAAKEAAAKEAAAKEAAAKAGSAGSAAGSGEFGSEQKLISEEDLEQKLISEEDLEQKLISEEDLGSAGSAAGSGEFGSAGSAAGSGEFGSAGSAAGSGEFGSG

SEQ ID NO: 180 - protein, 455 aa, Artificial Sequence
  scaffold polypeptide
MGSAGSAAGSGEFGSAGSAAGSGEFGSAGSAAGSGEFSYYHHHHHHLESTSLYKKAGSGSARNAYLRKKIARLKKDNLQLERDEQNLEKIIANLRDEIARLENEVASHEQGSAGSAAGSGEFAEAAAKEAAAKAGSAGSAAGSGEFSYYHHHHHHLESTSLYKKAGSGSNLVAQLENEVASLENENETLKKKNLHKKDLIAYLEKEIANLRKKIEEGSAGSAAGSGEFGSAEAAAKEAAAKEAAAKEAAAKAGSAGSAAGSGEFGSSATRELDELMASLSDFKIQGGSAGSAAGSGEFAEAAAKEAAAKAGSAGSAAGSGEFDLALSENWAQEFLAAGDAVDGSAGSAAGSGEFGSAEAAAKEAAAKEAAAKEAAAKAGSAGSAAGSGEFGSDYKDDDDKDYKDDDDKDYKDDDDKGSAGSAAGSGEFGSAGSAAGSGEFGSAGSAAGSGEFGSG

SEQ ID NO: 181 - DNA, 4596 bp, Artificial Sequence
  codon-optimized
atgagtgctaaggcaatttctgaacaaactggtaaagaattgttgtacaagtttatttgtactacatcagccatccaaaatagattcaaatacgctagagttaccccagatactgactgggctagattgttacaagatcatccatggttgttatctcaaaacttggttgtcaaacctgaccaattaattaagagaagaggtaaattgggtttagtaggtgttaatttgacattggatggtgtaaagtcttggttgaaaccaagattaggtcaagaagccacagttggtaaagctaccggtttcttgaaaaatttcttgatcgaaccatttgtccctcattcacaagccgaagaattctatgtatgtatctacgctactagagagggtgactatgttttatttcatcacgaaggtggtgtcgacgtaggtgacgttgacgccaaggctcaaaagttgttggttggtgtcgatgaaaagttgaacccagaagacattaaaaagcatttgttggttcacgcacctgaagataaaaaggaaatattggcctcctttataagtggtttgtttaatttctacgaagatttgtacttcacctacttggaaattaacccattagtagttactaaggatggtgtatatgttttggacttagctgcaaaagttgatgcaacagccgactacatttgtaaggtcaaatggggtgacatcgaatttccacctccattcggtagagaagcttatccagaagaagcctacattgctgatttggacgctaagtctggtgcatcattgaagttgacattgttgaaccctaaaggtagaatttggaccatggttgctggtggtggtgctagtgtcgtatattctgatactatatgcgacttgggtggtgttaacgaattggcaaactacggtgaatactcaggtgccccatccgaacaacaaacatacgattacgctaagaccatcttgtccttaatgactagagaaaagcatcctgatggtaaaatcttgatcatcggtggtagtatcgcaaattttactaacgttgccgctacattcaagggtatcgtcagagctataagagattaccaaggtccattgaaggaacacgaagtaacaatattcgttagaagaggtggtcctaactaccaagaaggtttgagagtcatgggtgaagtaggtaaaaccactggtataccaatccatgtctttggtacagaaacccacatgactgcaatagttggtatggccttaggtcatagaccaatccctaatcaacctccaaccgcagcccacactgcaaatttcttgttaaacgcctctggttcaacttccacaccagctccttctagaacagcaagtttctctgaatcaagagctgatgaagtcgctccagctaagaaagcaaaaccagccatgcctcaagactccgttccaagtcctagatctttgcagggtaaatctactactttgttttctagacatactaaggctatagtatggggtatgcaaacaagagcagttcaaggcatgttggatttcgactatgtttgtagtagagatgaaccatctgttgctgcaatggtctatccttttactggtgaccataagcaaaaattctactggggtcacaaggaaatattgatcccagtttttaagaacatggccgatgctatgagaaaacatcctgaagtcgacgtattgattaacttcgcctcattaagatccgcttacgattctacaatggaaaccatgaactacgctcaaataagaaccatcgctatcattgcagaaggtattccagaagccttgactagaaagttgattaagaaagctgatcaaaaaggtgtcacaataatcggtccagctaccgtaggtggtattaagcctggttgtttcaagatcggtaacactggtggtatgttggataacatattggcatctaagttgtatagaccaggttcagtcgcttacgtatccagaagtggtggtatgtccaacgaattgaacaacatcatcagtagaactacagatggtgtatacgaaggtgttgctattggtggtgacagatacccaggttctacttttatggatcatgtattgagatatcaagacacacctggtgttaaaatgattgttgtcttgggtgaaataggtggtactgaagaatacaagatatgcagaggtatcaaagaaggtagattgacaaagccaatcgtttgttggtgcattggtacttgtgcaacaatgttttcttcagaagttcaattcggtcatgcaggtgcctgcgctaatcaagcttcagaaacagcagttgccaagaaccaagcattaaaagaagccggtgtttttgtccctagatctttcgatgaattaggtgaaatcattcaatcagtctatgaagacttggtagctaatggtgtaattgttccagcacaagaagttcctccacctactgtccctatggattactcttgggcaagagaattgggtttaattagaaagccagctagttttatgacctctatatgtgatgaaagaggtcaagaattgatctatgctggtatgcctattactgaagtattcaaagaagaaatgggtatcggtggtgttttaggtttgttgtggttccaaaagagattgccaaagtactcttgtcaattcattgaaatgtgcttaatggttacagctgatcatggtcctgctgtctcaggtgcacacaataccataatctgcgctagagctggtaaagatttggtttcttctttgacctcaggtttgttaactattggtgacagatttggtggtgcattagacgccgctgcaaagatgttttcaaaagctttcgattccggtataatcccaatggaattcgttaataagatgaaaaaggagggtaaattgataatgggtatcggtcatcgtgttaagtctatcaataaccctgatatgagagtacaaatcttgaaggactatgttagacaacactttccagccacacctttgttagattacgctttggaagttgaaaagattaccacttctaaaaagccaaatttgatcttgaacgttgatggtttaattggtgttgcttttgtcgacatgttgagaaactgtggttccttcactagagaagaagctgatgaatatatcgacattggtgcattgaatggtatctttgttttaggtagatctatgggtttcattggtcattacttggatcaaaagagattaaagcaaggtttgtacagacatccatgggatgacatttcttacgttttacctgaacacatgtcaatgaaattgtctggtggtggtggttctggtggtggtggttctggtggtggtggtagtgccgaagcttggtacaatttgggtaacgcatactacaagcagggtgactaccaaaaggcaattgaatattaccaaaaggccttggaattagacccaaataacgcagaagcctggtataatttgggtaatgcttattataaacagggtgactatcaaaaggctatcgaatactaccaaaaggcattggaattagaccctaataacgctgaagcatggtataatttgggtaacgcttattataagcagggtgactatcaaaaagccatcgaagactaccaaaaggctttggaattagatccaaataacttacaagccgaagcttggaagaatttgggtaacgcttactataaacagggtgactaccaaaaagcaattgaatactatcaaaaagctttagaattggaccctaataacgcatcagcctggtacaatttgggtaatgcttactataagcagggtgactatcagaaggccattgaatactatcaaaaggctttagaattggatccaaataacgctaaagcatggtacagacgtggtaacgcttattacaaacagggtgactaccagaaagccattgaagattatcaaaaggctttggaattggatcctaacaacagatctagatcagctggtggtggtggttctggtggtggtggttctggtggtggtggtgcttcttcatattaccatcaccatcaccatcacttggaatccacaagtttatacaaaaaggctggttctggttcaaatttggtcgcacaattggaaaacgaagtagcctctttagaaaatgaaaacgaaaccttgaaaaagaaaaacttacataagaaagatttgatcgcttatttggaaaaggaaatcgcaaatttgagaaagaaaattgaagaaggtagtgcaggttctgccgctggttctggtgaatttggttcagctgaagcagccgctaaggaagcagccgctaaagccggttcagctggttccgcagccggttctggtgaattcggttccagttactatcaccatcaccatcatcacttggaatccactagtttatataagaaagcaggttctggttcagcaagaaatgcctacttgagaaagaaaatagctagattaaagaaagataacttgcaattggaaagagatgaacaaaatttggaaaagattatcgccaacttaagagatgaaatcgctagattggaaaatgaagttgcatcccatgaacaaggtagtggt

SEQ ID NO: 182 - DNA, 2472 bp, Artificial Sequence
  codon-optimized
atgaaaaactgtgtaatcgtttctgctgttagaactgcaattggttcctttaatggtagtttggcctctacatcagctattgatttgggtgctaccgtcatcaaagctgcaattgaaagagcaaagattgattctcaacatgtcgacgaagtaataatgggtaacgttttgcaagctggtttaggtcaaaatccagcaagacaagccttgttaaaatctggtttagcagaaactgtatgtggtttcacagttaataaggtctgcggttctggtttgaagtcagttgctttagccgctcaagctatacaagcaggtcaagcccaatctatcgtcgctggtggtatggaaaatatgtcattggcaccttatttgttagatgcaaaagccagatcaggttatagattaggtgacggtcaagtatacgacgttattttgagagatggtttaatgtgcgctactcatggttatcacatgggtattacagcagaaaatgttgccaaagaatacggtataaccagagaaatgcaagatgaattggcattacattcccaaagaaaggcagccgctgcaatcgaaagtggtgcttttactgcagaaattgtcccagtaaacgttgtcacaagaaagaaaactttcgttttctcccaagatgaattcccaaaagctaatagtaccgctgaagcattgggtgctttaagacctgcattcgacaaggccggtaccgtaactgccggtaatgcttctggtataaacgatggtgccgctgcattggttatcatggaagaatcagccgctttagcagccggtttgacacctttagctagaattaaatcttatgcatcaggtggtgttccacctgctttgatgggtatgggtccagtccctgctacccaaaaggcattgcaattagccggtttgcaattggctgatatcgacttaatcgaagcaaacgaagcctttgctgcacaattcttggcagttggtaaaaatttgggtttcgactccgaaaaggttaatgtcaacggtggtgccattgctttgggtcatccaataggtgcttcaggtgcaagaatcttggttacattgttgcatgccatgcaagctagagataaaaccttgggtttagctactttgtgtatcggtggtggtcaaggtatcgcaatggttatcgaaagattgaataagttgtctggtggtggtggttctggtggtggtggttctggtggtggtggtagtgcagaagcctggtacaatttgggtaacgcttactacaagcagggtgactaccaaaaggcaatcgaatactaccaaaaggccttggaattagatccaaataacgctgaagcatggtataatttgggtaatgcctattataaacagggtgactatcaaaaagctattgaatattaccaaaaggcattggaattagatcctaataacgccgaagcttggtataatttgggtaacgcctattataagcagggtgactatcaaaaggccatcgaagattaccaaaaggctttggaattggatccaaacaacttgcaagcagaagcctggaagaatttgggtaacgcttattacaaacagggtgactaccaaaaagctattgaatactatcaaaaagccttagaattggatcctaataacgcttctgcatggtacaatttgggtaatgcctactataaacagggtgactaccagaaggctattgaatactaccaaaaagcattagaattggatccaaataacgccaaggcttggtacagacgtggtaatgcctattacaagcagggtgactaccagaaagccatagaagactatcaaaaagccttggaattggatcctaacaacagatccagaagtgctggtggtggtggttctggtggtggtggttctggtggtggtggtgcttcttcatattaccatcaccatcaccatcacttggaatctacatcattatacaaaaaggctggttccggtagtaatgaagttactacattggaaaacgatgccgcttttatcgaaaacgaaaacgcatacttggaaaaggaaatcgccagattaagaaaggaaaaggcagccttgagaaatagattagcccataaaaagggttccgctggtagtgctgcaggttctggtgaatttggttcagctgaagccgctgcaaaagaagccgctgcaaaggcaggttctgccggttcagccgctggttctggtgaattcggttccagttactatcaccatcaccatcatcacttggaatctacttcattatataaaaaggccggttccggtagtcaaaaagtcgctgaattaaagaacagagtagctgttaagttgaacagaaacgaacaattgaaaaataaggtagaagaattgaaaaatagaaacgcctacttaaagaatgaattggcaacattggaaaacgaagtcgctagattggaaaatgatgtagcagaaggttctggt

SEQ ID NO: 183 - DNA, 2337 bp, Artificial Sequence
  codon-optimized
atgaaaaaggtttgtgtcattggtgctggtaccatgggttctggtatagcacaagcctttgctgcaaaaggtttcgaagttgtcttgagagatatcaaggacgaattcgttgatagaggtttggacttcatcaataagaacttgtctaagttggttaaaaagggtaaaatcgaagaagctacaaaggtagaaatcttgaccagaatttcaggtactgttgatttgaatatggccgctgattgtgacttggtaatcgaagcagccgttgaaagaatggatattaagaaacaaatcttcgcagatttggacaacatctgcaaacctgaaacaatcttagcctcaaacacctcttcattgtccattactgaagtcgctagtgcaacaaaaagaccagataaggtaataggcatgcatttctttaatccagctcctgttatgaagttggtagaagttattagaggtatagcaacatctcaagaaacctttgacgctgttaaggaaacttcaatagcaatcggtaaagatccagtcgaagtagccgaagctcctggtttcgtagttaacagaatcttgatacctatgatcaacgaagctgttggtatcttggctgaaggtattgcatctgtcgaagatattgacaaagccatgaagttaggtgctaatcacccaatgggtcctttggaattgggtgactttattggtttggacatatgtttagctatcatggacgttttgtattccgaaacaggtgacagtaaatacagaccacataccttgttgaagaaatatgttagagcaggttggttaggtagaaagtctggtaaaggtttctacgattactctaaaaagttgtctggtggtggtggttctggtggtggtggttctggtggtggtggtagtgcagaagcctggtacaatttgggtaacgcttactacaagcagggtgactaccaaaaggccatagaatactaccaaaaggctttggaattggatcctaataacgctgaagcatggtataatttgggtaatgcatattataaacagggtgactatcaaaaggcaatcgaatactaccaaaaggccttggaattagatccaaataacgccgaagcttggtataatttgggtaacgcctattataagcagggtgactatcaaaaagctatcgaagattaccaaaaggcattggaattggatcctaacaacttacaagcagaagcctggaagaatttgggtaacgcatattacaaacagggtgactaccaaaaagccattgaatattatcaaaaagctttggaattggatccaaataacgcttcagcatggtacaatttgggtaatgcctattacaagcagggtgactatcagaaagctattgaatattatcaaaaggctttggaattagatcctaataacgccaaggcttggtacagacgtggtaatgcctattacaagcagggtgactaccagaaggccattgaagactatcaaaaagccttggaattggatccaaacaacagatctagatcagctggtggtggtggttctggtggtggtggttctggtggtggtggtgcttccgaaaatttgtacttccaaggtgaaaacttgtacttccagggtgactccagtgaaagttgttggaattgcggtagaaaagcctccgaaacctgtagtggttgcaacactgctagatattgtggttctttttgccaacacaaagattgggaaaagcatcaccatatttgtggtcaaacattacaagcacaacaaggttctgccggttcagctgcaggttctggtgaatttggttccgctgaagccgctgcaaaagaagccgctgcaaaggcaggttccgccggtagtgccgctggtagtggtgaattcggttctatggcagtttccgaaagtcaattgaagaaaatggtttctaagtacaagtacagagatttgactgttagagaaacagttaacgtcatcactttgtacaaggatttgaagccagtcttggactcatacgtttttaatgatggttcttcaagagaattgatgaacttaactggtacaataccagttccttaccgtggtaacacttacaacatcccaatctgtttgtggttgttagatacatatccttacaatccacctatctgcttcgtcaaaccaacatccagtatgaccattaaaactggtaaacatgttgatgctaacggtaaaatatatttgccatacttacacgaatggaagcatcctcaatcagacttgttgggtttaatccaagtaatgatcgtcgtatttggtgacgaaccacctgttttctctagaccaggttcaggt

SEQ ID NO: 184 - DNA, 2232 bp, Artificial Sequence
  codon-optimized
atggaattgaacaacgttatattggaaaaggagggtaaagtcgctgttgtcactataaatagaccaaaggcattgaacgccttgaactctgatacattgaaggaaatggactacgttatcggtgaaattgaaaacgattcagaagtcttagcagtaattttgaccggtgccggtgaaaaatcctttgttgccggtgctgatatcagtgaaatgaaggaaatgaacactatcgaaggtagaaagttcggtatcttgggtaacaaggttttcagaagattggaattgttggaaaagcctgttatagctgcagtcaatggtttcgctttgggtggtggttgtgaaatcgcaatgtcctgcgatattagaatagcttcttcaaacgcaagatttggtcaaccagaagtcggtttaggtattacacctggtttcggtggtacccaaagattatctagattggttggtatgggtatggccaagcaattgatttttactgctcaaaacatcaaggctgatgaagcattgagaatcggtttggttaataaggtagttgaaccatctgaattgatgaacaccgccaaggaaatcgctaataagattgtttctaatgctccagttgctgtcaagttgagtaagcaagctataaatcgtggtatgcaatgtgatatcgacactgcattggccttcgaatctgaagcatttggtgaatgcttctcaacagaagatcaaaaagacgcaatgaccgcctttatcgaaaagagaaagatagaaggtttcaaaaacagaaagttatctggtggtggtggttctggtggtggtggttctggtggtggtggtagtgctgaagcatggtacaatttgggtaacgcttactacaagcagggtgactaccaaaaggcaatcgaatactaccaaaaggccttggaattggacccaaataacgccgaagcttggtataatttgggtaatgcctattataaacagggtgactatcaaaaagctatagaatactaccaaaaggcattggaattggaccctaataacgcagaagcctggtataatttgggtaacgcctattataagcagggtgactatcaaaaggccatagaagactaccaaaaggctttggaattggatccaaacaacttacaagctgaagcatggaagaatttgggtaacgcttattacaaacagggtgactaccaaaaagctattgaatattatcaaaaagctttagaattagaccctaataacgcctctgcttggtacaatttgggtaatgcctactataaacagggtgactaccagaaggctattgaatattaccaaaaagctttagaattggatccaaataacgcaaaggcctggtacagacgtggtaatgcctattacaagcagggtgactaccagaaagccattgaagattatcaaaaagctttggaattggatcctaacaacagatccagaagtgctggtggtggtggttctggtggtggtggttctggtggtggtggtgcttctggtccattgggttcccctttgactgcatcaatgttagcttccgcaccacctcaagaacaaaagcaaatgttgggtgaaagattattcccattgatacaagctatgcatcctactttagcaggtaaaatcacaggcatgttgttggaaatcgataactctgaattgttacacatgttagaatccccagaaagtttgagatctaaagttgacgaagccgtagctgttttgcaagctcatcaagcaaaagaagccgctcaaaaggccggttcagctggttccgcagccggtagtggtgaatttggttctgctgaagctgcagccaaagaagctgcagccaaggcaggtagtgccggttctgctgcaggttctggtgaattcggttccaataccaacatgagtgtcccaactgatggtgctgtaactacatctcaaattcctgcatcagaacaagaaactttagttagaccaaagcctttgttgttgaagttgttgaagtcagtaggtgctcaaaaagatacctacactatgaaggaagttttattttatttgggtcaatacatcatgacaaagagattatacgatgaaaagcaacaacatatcgtttactgttcaaacgatttgttgggtgacttgtttggtgtaccatctttctcagttaaggaacacagaaagatctatacaatgatatacagaaatttggtcgtaggttctggt

SEQ ID NO: 185 - DNA, 2469 bp, Artificial Sequence
  codon-optimized
atgatcgtaaagccaatggttagaaacaacatctgtttgaacgctcatcctcaaggttgcaaaaagggtgtagaagatcaaatcgaatacaccaaaaagagaatcactgcagaagttaaagccggtgctaaagcacctaagaatgttttggtcttaggttgttccaacggttatggtttggctagtagaataacagctgcatttggttacggtgccgctaccatcggtgtttccttcgaaaaggctggtagtgaaaccaaatatggtactccaggttggtacaataacttggcatttgatgaagcagccaagagagaaggtttatactctgtcactatagatggtgacgctttctcagatgaaatcaaggcacaagttattgaagaagccaaaaagaaaggtataaaattcgatttgatcgtttactccttagcaagtccagtcagaacagatcctgacaccggtataatgcataagtctgttttgaagccattcggtaaaactttcacaggtaaaacagtcgatcctttcaccggtgaattgaaagaaatatctgctgaaccagcaaatgatgaagaagctgcagccacagtaaaagttatgggtggtgaagactgggaaagatggatcaagcaattgtccaaagaaggtttgttggaagaaggttgtatcaccttagcttattcatacattggtcctgaagccactcaagctttgtatagaaaaggtacaatcggtaaagctaaagaacatttggaagccaccgctcacagattaaataaggaaaacccatctatcagagcatttgtttctgtaaataagggtttagttactagagcatccgccgttatcccagtcattcctttgtatttggctagtttgtttaaggttatgaaggaaaagggtaaccatgaaggttgcatagaacaaatcactagattgtacgcagaaagattatacagaaaggatggtacaattccagttgacgaagaaaacagaatcagaatcgatgactgggaattggaagaagatgtccaaaaggcagtatctgccttaatggaaaaagttaccggtgaaaacgctgaatcattgactgatttggcaggttatagacacgactttttagcctctaatggtttcgatgtcgaaggtattaactacgaagcagaagtagaaagattcgacagaattaaattgtctggtggtggtggttctggtggtggtggttctggtggtggtggtagtgctgaagcatggtataatttgggtaacgcttattacaagcagggtgactaccaaaaggccatcgaatactaccaaaaggctttggaattggaccctaataacgccgaagcttggtacaatttgggtaatgcctactataaacagggtgactatcaaaaagcaattgaatattaccaaaaggccttggaattagacccaaataacgcagaagcctggtacaatttgggtaacgcctactataagcagggtgactatcaaaaggctattgaagactaccaaaaggcattggaattagatcctaataacttgcaagctgaagcatggaaaaatttgggtaatgcctattataaacagggtgactaccaaaaagctattgaatactatcaaaaagctttggaattggacccaaataacgcctcagcttggtataatttgggtaatgcatactacaaacagggtgactatcagaaggcaatagaatactatcaaaaagccttagaattggatcctaataacgcaaaagcctggtatagacgtggtaatgcctactacaagcagggtgactatcagaaggcgatagaagattatcaaaaggcattggaattggatccaaacaacagatctagatcagctggtggtggtggttctggtggtggtggttctggtggtggtggtgcttcttcatattaccatcaccatcaccatcacttggaatccacaagtttatataagaaagcaggttctggttcaaatttgttagccactttgagatcaacagctgcagtattggaaaacgaaaaccatgttttggaaaaagaaaaggaaaagttgagaaaggaaaaggaacaattgttgaataagttggaagcctacaaaggttctgctggttcagccgctggttccggtgaattcggtagtgctgaagcagccgctaaggaagcagccgctaaagctggttccgcaggtagtgcagccggttctggtgaatttggttccagttactatcaccatcaccatcatcacttggaatccactagtttatataagaaagctggttctggttcaaagagaatcgcatacttgagaaagaaaatcgctgcattaaagaaagataacgccaacttggaaaaggacatcgctaatttggaaaacgaaatcgaaagattgattaaagaaattaaaacattagaaaatgaagttgcttctcatgaacaaggttcaggt

SEQ ID NO: 186 - DNA, 2487 bp, Artificial Sequence
  codon-optimized
atgactagagaagttgtcgtagttagtggtgttagaacagctattggtacctttggtggttctttaaaagatgttgcaccagccgaattgggtgcattagtcgtaagagaagctttggcaagagcccaagtttcaggtgacgatgtcggtcatgttgtcttcggtaacgttatccaaacagaaccaagagatatgtatttgggtagagtagctgcagttaatggtggtgttaccataaacgctcctgcattaactgtcaacagattgtgtggtagtggtttacaagctattgtttctgccgctcaaacaatattgttaggtgacaccgacgttgctatcggtggtggtgctgaatctatgtcaagagccccatacttagctcctgcagccagatggggtgccagaatgggtgacgctggtttggttgacatgatgttgggtgctttgcatgatccattccatagaatccacatgggtgtaactgcagaaaacgttgccaaggaatacgatatctcaagagcacaacaagacgaagctgcattagaatcacacagaagagcatccgccgctattaaagccggttactttaaggatcaaatagttccagtagtttctaaaggtagaaagggtgacgttaccttcgatactgacgaacatgttagacacgacgctactattgatgacatgacaaagttaagacctgttttcgtcaaggaaaatggtactgttacagctggtaatgcatctggtttgaacgatgcagccgctgcagtcgtaatgatggaaagagccgaagctgaaagaagaggtttgaaaccattagctagattggtttcttatggtcatgctggtgtcgatcctaaagcaatgggtataggtccagttcctgctactaagatcgcattggaaagagccggtttacaagtctctgatttggacgtaattgaagccaatgaagcttttgccgctcaagcatgtgccgttacaaaagccttgggtttagatccagctaaggtcaatcctaacggtagtggtatctctttaggtcatccaattggtgcaaccggtgccttgataactgttaaggctttgcacgaattgaacagagtacaaggtagatatgcattagttacaatgtgcatcggtggtggtcaaggtattgcagccatattcgaaagaattaagttgtctggtggtggtggttctggtggtggtggttctggtggtggtggtagtgctgaagcatggtacaatttgggtaacgcttactacaagcagggtgactaccaaaaggcaatcgaatattaccaaaaagccttggaattagacccaaataacgccgaagcttggtataatttgggtaatgcctattataaacagggtgactatcaaaaagctatagaatactaccaaaaggcattggaattagaccctaataacgcagaagcctggtataatttgggtaacgcctattataagcagggtgactatcaaaaggccatagaagactaccaaaaggctttggaattggatccaaacaacttacaagctgaagcatggaagaatttgggtaacgcttattacaaacagggtgactaccaaaaagctattgaatactatcaaaaggctttagaattggaccctaataacgcctctgcttggtacaatttgggtaatgcctactataaacagggtgactaccagaaggctatcgaatattatcaaaaagctttagaattggacccaaataacgcaaaggcctggtacagacgtggtaatgcctattacaagcagggtgactaccagaaagctattgaagattatcaaaaggcattggaattggatcctaacaacagatccagaagtgctggtggtggtggttctggtggtggtggttctggtggtggtggtgcttctgatgttatgtgggaatataagtgggaaaatacaggtgacgctgaattatacggtccttttacttcagcacaaatgcaaacatgggtatccgaaggttatttccctgatggtgtttactgcagaaaattagacccacctggtggtcaattctacaactcaaagagaatagatttcgacttgtacaccggttcagctggttccgctgcaggttctggtgaatttggttccgcagaagccgctgcaaaagaagccgctgcaaaggctggtagtgcaggttctgccgctggtagtggtgaatttggttctgaatcagattccgtcgaattcaataacgctatatcttacgtaaataagattaaaaccagatttttagatcatccagaaatctatagatcattcttagaaatcttgcatacataccaaaaagaacaattgcacaccaagggtagacctttcagaggcatgtccgaagaagaagtctttactgaagtagctaatttgtttagaggtcaagaagatttgttgtcagaattcggtcaattcttgccagaagcaaaaagaggttccggt

SEQ ID NO: 187 - DNA, 2169 bp, Artificial Sequence
  codon-optimized
atgggtaaaaattacaagtcattggattccgttgtcgcaagtgactttattgccttgggtataacttctgaagtcgcagaaacattgcatggtagattagccgaaattgtatgtaactacggtgctgcaaccccacaaacttggatcaacatagcaaaccatatcttgtcaccagatttgcctttctccttgcaccaaatgttgttttatggttgctacaaggatttcggtcctgctccacctgcatggattccagaccctgaaaaggttaagtcaactaatttgggtgctttgttagaaaagagaggtaaagaattcttgggtgttaagtacaaggatccaatctcttctttttctcacttccaagaattttctgtcagaaaccctgaagtatactggagaacagttttgatggatgaaatgaaaataagtttctctaaggacccagaatgtatcttgagaagagatgacatcaacaacccaggtggttctgaatggttgccaggtggttatttgaactcagctaaaaattgcttgaacgttaactccaataagaaattgaatgatactatgattgtctggagagatgaaggcaacgatgacttgccattgaataagttgacattggatcaattgagaaagagagtttggttggtcggttacgcattagaagaaatgggtttggaaaaaggttgtgccatagctatcgatatgcctatgcatgtagacgctgtagttatctatttggctattgttttagcaggttacgtcgtagtttctatagctgattcattttccgcaccagaaatctcaactagattgagattatccaaagcaaaggccatattcacacaagatcacatcatcagaggtaaaaagagaatccctttatactcaagagtcgtagaagccaaatccccaatggctatagttatcccttgtagtggttctaacattggtgcagaattaagagatggtgacatatcttgggattactttttggaaagagccaaagaattcaagaattgcgaattcactgccagagaacaaccagttgatgcttacactaacattttgttctccagtggtactacaggtgaaccaaaagcaataccttggacacaagccacccctttaaaggccgctgcagatggttggtcacatttggatattagaaaaggtgacgtcatagtatggccaactaatttgggttggatgatgggtccttggttggtttatgctagtttgttaaatggtgcctctattgctttatacaacggtagtccattggtttctggtttcgctaaatttgtccaagatgcaaaagtaacaatgttgggtgttgtcccttcaatcgttagaagttggaagtctacaaattgtgtctcaggttatgattggtccaccatcagatgcttttcttcatccggtgaagcctctaatgtcgacgaatatttgtggttaatgggtagagctaactacaagccagttatcgaaatgtgtggtggtaccgaaattggtggtgcattctcagccggttcctttttacaagctcaatcattgagttctttttcatcccaatgtatgggttgcacattgtacatcttggataagaacggttacccaatgcctaaaaataagccaggtattggtgaattggctttaggtcctgttatgttcggtgcatctaaaacattgttgaacggtaaccatcacgatgtatacttcaagggtatgccaaccttaaatggtgaagttttgagaagacatggtgacatattcgaattaacctcaaacggttactaccatgcccacggtagagctgatgacactatgaacatcggtggtatcaaaatcagttctatcgaaatcgaaagagtatgtaacgaagttgatgacagagtctttgaaaccactgcaattggtgttccaccattgggtggtggtccagaacaattagtaatctttttcgttttgaaggattctaacgacacaaccatagatttgaaccaattgagattatcttttaacttgggtttacaaaagaaattgaacccattattcaaagttactagagtagttccattgtcatccttacctagaactgctacaaacaagattatgagaagagtcttgagacaacaattcagtcattttgaaggttctggt

SEQ ID NO: 188 - DNA, 2556 bp, Artificial Sequence
  codon-optimized
atgaagttatctactaaattgtgttggtgcggtattaagggtagattaagaccacaaaagcaacaacaattgcataacacaaacttgcaaatgaccgaattgaagaaacaaaagactgctgaacaaaagactagaccacaaaacgttggtattaaaggtatccaaatctatatccctacacaatgtgtcaatcaatctgaattggaaaagtttgatggtgtatcacagggtaaatacactatcggtttaggtcaaacaaacatgtctttcgtaaacgatagagaagacatctattctatgtcattgactgttttgtccaagttgataaaaagttacaacatcgatacaaacaagattggtagattggaagttggtaccgaaactttgatcgataagtccaagagtgtcaagtctgtattgatgcaattgttcggtgaaaataccgatgttgaaggtatcgacactttaaatgcttgttatggtggtactaacgcattattcaattcattgaactggatcgaatccaatgcctgggatggtagagatgctattgttgtctgcggtgacatcgctatctatgacaaaggtgctgcaagaccaaccggtggtgcaggtactgttgccatgtggataggtccagatgcacctatcgtttttgactctgtcagagcatcatacatggaacatgcctacgatttctacaaaccagacttcacctccgaatatccttacgttgatggtcacttttctttgacttgttacgtcaaggctttggaccaagtatacaagtcttactctaagaaagcaatatctaagggtttggtttcagatccagctggttccgacgcattaaacgtcttgaagtacttcgattacaacgttttccatgtccctacatgcaagttggttaccaagtcttacggtagattgttgtacaacgatttcagagctaacccacaattgttccctgaagtcgacgctgaattagcaactagagattacgacgaatctttgacagataagaacatcgaaaagactttcgtaaacgttgcaaagccattccacaaagaaagagttgcccaatcattaattgtccctacaaataccggtaacatgtatacagcctcagtttacgccgcttttgcttccttgttaaattatgtaggtagtgatgacttgcaaggtaaaagagttggtttattctcctatggtagtggtttagcagcctctttgtactcttgtaagattgtaggtgacgttcaacacattattaaggaattggacatcactaataagttggctaagagaatcactgaaacaccaaaggattatgaagctgcaatcgaattgagagaaaacgcacatttgaagaaaaatttcaaacctcaaggtagtatagaacacttgcaatctggtgtctactacttaacaaacatcgatgacaaattcagaagatcatacgatgttaaaaagaaattgtctggtggtggtggttctggtggtggtggttctggtggtggtggtagtgctgaagcatggtataatttgggtaacgcttattacaagcagggtgactaccaaaaagcaatcgaatattaccaaaaggccttggaattagacccaaataacgccgaagcttggtacaatttgggtaatgcatactataaacagggtgactatcaaaaggctatcgaatactaccaaaaggcattggaattagaccctaataacgcagaagcctggtacaatttgggtaacgcctactataagcagggtgactatcaaaaagccatagaagactaccaaaaggctttggaattagatccaaataacttgcaagctgaagcatggaaaaatttgggtaatgcctactacaaacagggtgactaccaaaaggcaattgaatattatcaaaaagccttggaattagatcctaataacgcctcagcttggtataatttgggtaatgcctattataagcagggtgactaccagaaagccattgaatattatcaaaaggctttagaattggatccaaataacgcaaaagcctggtatagacgtggtaatgcctactacaagcagggtgactatcagaaggctattgaagattatcaaaaagctttggaattggatccaaacaacagatccagaagtgctggtggtggtggttctggtggtggtggttctggtggtggtggtgcttctttgggtcctttgccacctggttgggaagtaagatccacagttagtggtagaatctatttcgttgatcataacaacagaactacacaattcaccgacccaagattgcacggttctgctggttcagccgctggttctggtgaatttggttccgcagaagcagccgctaaggaagcagccgctaaagccggttccgctggtagtgcagccggtagtggtgaatttggttctggtgctatgggtccattaccacctggttgggaaaagagaacagattctaacggtagagtctacttcgtaaaccataataccagaattactcaatgggaagatcctagatctggttcaggt

SEQ ID NO: 189 - DNA, 2487 bp, Artificial Sequence
  codon-optimized
atggtagccgttagaagaaaggctttgtctatcttagccgaagctccagttttggcatcagatagattaccttacaagaactacgattacgacagagtatttggtgcttgttgcgaaaacgttattggttatatgccattgcctgtcggtgtaatcggtccattagttattgatggtacatcttaccatatccctatggcaactacagaaggttgtttggttgcatcagccatgagaggttgcaaggcaattaatgctggtggtggtgctaccactgttttaaccaaagatggtatgactagaggtccagttgtcagatttcctactttgaagagatccggtgcttgtaaaatatggttagatagtgaagaaggtcaaaatgccatcaaaaaggcttttaactccactagtagattcgcaagattgcaacatattcaaacatgcttagccggtgacttgttgtttatgagattcagaacaaccactggtgacgctatgggtatgaatatgatatctaagggtgtcgaatactcattgaagcaaatggtagaagaatacggttgggaagatatggaagtagtttctgtttcaggcaactactgtactgacaaaaagccagctgcaattaactggatagaaggtcgtggtaaatctgtcgtagctgaagcaacaatacctggtgacgttgttagaaaggttttgaaatctgacgtatcagctttggttgaattgaacatcgctaaaaatttggttggttccgccatggctggtagtgtcggtggttttaatgcacatgccgctaacttagttacagcagtcttcttggccttaggtcaagatccagctcaaaacgtagaatcttcaaactgtatcaccttgatgaaagaagttgatggtgacttaagaatatccgttagtatgccatcaatagaagtcggtacaatcggtggtggtaccgtcttggaacctcaaggtgcaatgttagatttgttaggtgttagaggtccacatgcaactgcccctggtacaaatgctagacaattggcaagaattgtcgcttgtgcagtattagctggtgaattgtccttatgcgcagccttggctgcaggtcacttagttcaaagtcatatgacacacaacagaaagttgtctggtggtggtggttctggtggtggtggttctggtggtggtggtagtgccgaagcttggtataatttgggtaacgcatattacaagcagggtgactaccaaaaggccatcgaatactaccaaaaggctttggaattggacccaaataacgcagaagcctggtacaatttgggtaatgcttactataaacagggtgactatcaaaaggcaattgaatattaccaaaaggccttggaattagaccctaataacgctgaagcatggtacaatttgggtaacgcctactataagcagggtgactatcaaaaagctattgaagactaccaaaaggcattggaattagatccaaataacttgcaagccgaagcttggaaaaatttgggtaacgcttactacaaacagggtgactaccaaaaagctattgaatactatcaaaaagctttggaattggaccctaataacgcatctgcctggtataatttgggtaatgcttattataaacagggtgactaccagaaggcaatagaatactatcaaaaagccttggaattagacccaaataacgctaaagcatggtatagacgtggtaatgcttactataagcagggtgactaccagaaagctatagaagattatcaaaaggcattggaattggatcctaacaacagatctagatcagctggtggtggtggttctggtggtggtggttctggtggtggtggtgcttccagttattaccatcaccatcaccatcacttggaatccactagtttatacaaaaaggcaggttcagaatttttcagaagagaaagaaataagatggccgctgcaaaatgtagaaacagaagaagagaattgacagataccttacaagctgaaaccgatcaattggaagacgaaaagtctgcattgcaaactgaaatagccaatttgttgaaggaaaaggaaaagttggaattcattttagccgctcatagaccagcttgcaaaattcctgatgacttgggtttcccagaagaaatgtctttagaaggttccgcaggtagtgcagccggttccggtgaatttggtagtgctgaagctgcagccaaggaagctgcagccaaagctggttctgcaggttcagctgcaggttccggtgaattcggttcttcatactatcaccatcaccatcatcacttggaatctacctcattatacaaaaaggctggttccggtagtcaaaaggttgaatctttgaagcaaaagattgaagaattgaagcaaagaaaagcccaattgaagaatgatatcgctaacttagaaaaggaaatcgcctacgctgaaactggttctggt

SEQ ID NO: 190 - DNA, 3147 bp, Artificial Sequence
  codon-optimized
atgagtttaccatttttgacatctgctcctggtaaagttattatattcggtgaacatagtgccgtctataataagccagctgtcgctgcatctgtatcagctttgagaacatacttgttgatctctgaatcttcagcacctgataccatcgaattggatttcccagacatctcattcaatcacaagtggtccattaatgatttcaacgctatcaccgaagaccaagtaaactcacaaaagttggccaaagctcaacaagcaactgatggtttgtcacaagaattagtttccttgttagacccattgttggctcaattgtccgaaagtttccattaccacgccgctttctgtttcttgtacatgttcgtttgtttatgccctcatgctaagaatatcaaattttctttgaagtctactttgccaattggtgcaggtttaggttccagtgcctctatatcagtttccttagcattggccatggcttatttgggtggtttgataggtagtaacgatttggaaaagttgtctgaaaacgacaagcatatcgtcaaccaatgggcattcatcggtgaaaaatgcattcacggtactcctagtggtatagataatgcagttgccacatatggtaacgctttgttattcgaaaaggactctcataacggtaccatcaacactaacaacttcaagttcttggatgactttcctgcaataccaatgatcttgacttacacaagaattccaagatctactaaagatttggtagctagagtcagagtattggttacagaaaagttccctgaagttatgaagccaatcttggatgcaatgggtgaatgtgccttgcaaggtttggaaatcatgacaaagttgtcaaagtgcaagggtactgatgacgaagctgttgaaacaaataacgaattgtacgaacaattgttggaattgatcagaatcaatcatggtttgttagtttcaattggtgtctcccacccaggtttagaattgataaagaacttgtcagatgacttaagaatcggttccacaaaattgaccggtgctggtggtggtggttgttctttgaccttgttaagaagagatatcactcaagaacaaatcgacagttttaaaaagaaattgcaagatgacttctcttacgaaactttcgaaacagatttgggtggtactggttgttgcttgttgtcagctaagaatttgaacaaagatttgaagattaaatccttggttttccaattgttcgaaaataagactacaaccaagcaacaaatcgatgacttgttgttgcctggtaatacaaacttgccatggacctcaaaattatctggtggtggtggttctggtggtggtggttctggtggtggtggtagtgctgaagcatggtataatttgggtaacgcatattacaagcagggtgactaccaaaaggctatcgaatactaccaaaaggcattggaattggaccctaataacgccgaagcttggtacaatttgggtaatgcttactataaacagggtgactatcaaaaggccattgaatattaccaaaaggctttggaattggacccaaataacgcagaagcctggtacaatttgggtaacgcttactataagcagggtgactatcaaaaagcaattgaagactaccaaaaggccttagaattggatcctaataacttgcaagctgaagcatggaaaaatttgggtaacgcttattataaacagggtgactaccaaaaagccattgaatactatcaaaaagcattggaattggatccaaataacgcctctgcttggtataatttgggtaatgcttattataagcagggtgactaccagaaagccatagaatactatcaaaaagctttggaattagaccctaataacgcaaaagcctggtatagacgtggtaatgcttactacaaacagggtgactatcagaaggcaatagaagattatcaaaaagctttagaattagacccaaataacagaagtagatctgctggtggtggtggttctggtggtggtggttctggtggtggtggtgcttctatggaacctgcaatggaaccagaaacattggaagccagaatcaatagagctaccaatcctttgaacaaggaattggattgggcttctattaatggtttctgtgaacaattgaacgaagacttcgaaggtccacctttagcaacaagattattggcccataaaattcaatcaccacaagaatgggaagcaatacaagccttaaccgtcttggaaacttgtatgaagtcctgcggtaaaagattccacgatgaagttggtaaattcagatttttgaacgaattgatcaaggttgtctcacctaagtatttgggtagtagaacatctgaaaaggttaaaaacaagatcttggaattgttgtactcctggaccgtaggtttaccagaagaagttaagatcgctgaagcataccaaatgttgaagaaacaaggtattgttaagtcaggttccgccggtagtgcagccggttctggtgaattcggttctgcagaagctgcagccaaggaagctgcagccaaagctggttcagcaggttccgctgcaggttctggtgaatttggttcaggtgcaatgggttccatggccgaagctgaaggtgaaagtttggaatcttggttaaataaggctacaaatccatcaaacagacaagaagattgggaatatatcattggtttctgtgaccaaatcaataaggaattggaaggtcctcaaatagctgttagattattggcacataagatccaatctccacaagaatgggaagccttacaagctttgactgttttagaagcttgtatgaagaattgcggtagaagatttcacaacgaagtcggtaaattcagatttttgaatgaattaattaaggtagttagtccaaaatacttaggtgacagagtttctgaaaaggttaagaccaaagtcatagaattgttgtactcttggactatggccttgcctgaagaagctaagatcaaagatgcataccatatgttgaagagacaaggtatagtccaatcagatccacctatcccagtagacagaactttgattccatctccaccaccaagacctaaaaatggttccggt

SEQ ID NO: 191 - DNA, 2610 bp, Artificial Sequence
  codon-optimized
atgtccgaattaagagcttttagtgcacctggtaaagccttgttagctggtggttatttggttttggatacaaagtacgaagcattcgttgtcggtttgtcagccagaatgcatgcagtcgcccacccttacggttctttacaaggttctgataagttcgaagtaagagtcaagtctaagcaattcaaggacggtgaatggttataccatatatctccaaagtcaggttttattcctgtttccataggtggtagtaaaaatccattcatcgaaaaggttattgcaaacgtcttttcttacttcaagcctaacatggatgactactgtaacagaaacttgttcgtcatcgatatattctctgatgacgcttatcattctcaagaagactcagtaactgaacacagaggtaatagaagattgtcctttcatagtcacagaattgaagaagttccaaaaaccggtttaggttcttcagctggtggtttagtcactgtattgactacagctttagcatcctttttcgttagtgatttggaaaacaacgtagacaagtacagagaagttattcataatttggcacaagtagcccactgccaagcacaaggtaaaatcggttccggttttgatgttgctgcagccgcttatggttcaattagatacagaagattcccacctgctttgatatctaatttgccagatatcggttctgctacatatggttcaaagttggcacatttggttgatgaagaagactggaacatcacaattaaatccaaccatttgcctagtggtttgaccttatggatgggtgacattaagaatggttctgaaactgttaagttggtccaaaaagtaaagaactggtacgattctcatatgccagaatcattgaagatctacacagaattagaccatgctaattccagattcatggatggtttgagtaaattagacagattgcatacccacgatgactactctgatcaaatcttcgaatcattggaaagaaacgactgtacttgccaaaaatacccagaaatcacagaagtaagagatgccgttgctaccataagaagatcttttagaaagatcactaaggaatcaggtgcagatatcgaaccacctgttcaaacatctttgttagatgactgtcaaaccttgaagggtgtcttaacttgcttgattccaggtgctggtggttatgatgcaatagccgtcatcactaaacaagatgtagacttgagagctcaaacagcaaacgataagagattttcaaaggtccaatggttagatgtaacccaagctgactggggtgttagaaaagaaaaggatcctgaaacttacttggacaaaaagttatctggtggtggtggttctggtggtggtggttctggtggtggtggtagtgctgaagcatggtacaatttgggtaacgcatactacaagcagggtgactaccaaaaggccatagaatactaccaaaaggctttggaattggacccaaataacgccgaagcttggtataatttgggtaatgcttattataaacagggtgactatcaaaaggcaatcgaatactaccaaaaggccttggaattagaccctaataacgcagaagcctggtataatttgggtaacgcttattataagcagggtgactatcaaaaagctatcgaagactaccaaaaggcattggaattagatccaaataacttgcaagctgaagcatggaagaatttgggtaacgcttactataaacagggtgactaccaaaaagccattgaatattatcaaaaagctttggaattggatcctaataacgcctctgcttggtacaatttgggtaatgcttactataagcagggtgactatcagaaggctattgaatattatcaaaaggctttagaattggaccctaataacgcaaaggcctggtacagacgtggtaacgcttattacaaacagggtgactaccagaaagctattgaagattatcaaaaggcattggaattggatcctaacaacagatccagaagtgctggtggtggtggttctggtggtggtggttctggtggtggtggtgcttccagttattaccatcaccatcaccatcacttggaatctacatcattatacaaaaaggctggttccggtagtcaaaaggttgaagaattgaaaaataagatagccgaattggaaaacagaaacgctgttaaaaagaacagagtcgcacatttgaaacaagaaatagcctacttgaaggatgaattagcagcccatgaatttgaaggttctgccggttcagctgcaggttctggtgaattcggttcagctgaagccgctgcaaaagaagccgctgcaaaggccggttccgctggtagtgccgctggttctggtgaatttggttcttcatactatcaccatcaccatcatcacttggaatctacttcattatataaaaaggccggttccggtagtttcgaaaacgttacacatgaattcattttggctaccttggaaaacgaaaacgcaaagttaagaagattggaagccaagttggaaagagaattagctagattgagaaatgaagttgcatggttaggttctggt

SEQ ID NO: 192 - DNA, 3033 bp, Artificial Sequence
  codon-optimized
atgacagtttataccgcttctgtcaccgcacctgtaaatattgctactttgaaatactggggtaaaagagatactaagttgaatttgccaacaaactcttcaatctcagttacattgtcccaagatgacttaagaaccttgacttctgctgcaactgctcctgaattcgaaagagatacattgtggttgaatggtgaaccacattctatcgacaacgaaagaactcaaaactgtttgagagatttgagacaattgagaaaggaaatggagagtaaggatgcttctttgcctacattgagtcaatggaagttgcacatagtttctgaaaacaacttcccaaccgccgctggtttggcatccagtgcagccggtttcgctgcattagtctctgcaatcgccaagttgtaccaattgccacaaagtacatctgaaatcagtagaatcgctagaaaaggttcaggttccgcatgtagatctttatttggtggttacgtcgcatgggaaatgggtaaagccgaagacggtcatgattcaatggccgtacaaatagctgactcttcagattggcctcaaatgaaagcttgcgtcttggttgtctcagacatcaaaaaggatgtatccagtacacaaggcatgcaattgactgttgcaacatccgaattgtttaaagaaagaatcgaacacgtagttccaaaaagattcgaagtcatgagaaaggctatcgtagaaaaggatttcgccaccttcgctaaggaaactatgatggacagtaactctttccatgcaacttgtttggattcatttccacctattttctatatgaacgacacctcaaagagaataatctcctggtgccacactatcaaccaattctacggtgaaacaatcgttgcttacaccttcgatgcaggtcctaatgccgtcttgtattacttagccgaaaacgaatcaaagttgttcgcttttatatataagttgtttggttccgttccaggttgggataaaaagttcactacagaacaattggaagcttttaatcatcaattcgaatcttcaaactttactgccagagaattggacttagaattgcaaaaggatgtagctagagttatcttgacccaagttggttcaggtcctcaagaaactaacgaatccttgatagatgctaagacaggtttgccaaaagaaaaattgtctggtggtggtggttctggtggtggtggttctggtggtggtggtagtgctgaagcatggtataatttgggtaacgcttattacaagcagggtgactaccaaaaggccatcgaatactaccaaaaggctttggaattggaccctaataacgccgaagcttggtacaatttgggtaatgcctactataaacagggtgactatcaaaaagcaattgaatattaccaaaaggccttggaattggacccaaataacgcagaagcctggtacaatttgggtaacgcctactataagcagggtgactatcaaaaggctatcgaagattaccaaaaggcattagaattggatcctaataacttgcaagctgaagcatggaaaaatttgggtaatgcctattataaacagggtgactaccaaaaagctattgaatactatcaaaaagctttagaattagacccaaataacgcctcagcttggtataatttgggtaatgcatactacaaacagggtgactatcagaaggcaattgaatactatcaaaaggcattagaattagatcctaataacgcaaaagcctggtatagacgtggtaatgcctactacaagcagggtgactatcagaaggcgattgaagactaccaaaaggcattggaattggatccaaacaacagatcaagatccgctggtggtggtggttctggtggtggtggttctggtggtggtggtgcttctgcaatggccgatttggaacaaaaggtattggaaatggaagctagtacatatgacggtgtttttatttggaagatctctgatttcccaagaaaaagacaagaagctgttgcaggtagaatccctgctatttttagtccagcattctacacctctagatacggttacaagatgtgtttgagaatatatttgaatggtgacggtactggtagaggtactcatttgtctttgtttttcgtcgtaatgaagggtcctaatgatgctttgttgagatggccttttaatcaaaaggttaccttgatgttgttggatcaaaacaacagagaacacgttatcgacgcttttagacctgatgtcacttccagttctttccaaagaccagttaatgatatgaacattgcttctggttgtcctttgttttgcccagtctcaaagatggaagctaaaaattcctatgttagagatgacgccatcttcattaaggctatcgttgatttgactggtttaggttcagcaggttccgccgctggttctggtgaatttggttccgccgaagcagccgctaaggaagcagccgctaaagcaggtagtgccggttctgcagccggctctggcgaatttggtagtgcctctattaaattgcaatcatccgacggtgaaatcttcgaagttgatgtcgaaatagcaaagcaatctgttaccataaaaactatgttggaagatttgggtatggatgacgaaggtgacgatgatccagttcctttgccaaatgtcaacgctgcaatattgaagaaagttattcaatggtgcacacatcacaaggacgatccacctccacctgaagacgatgaaaataaggaaaagagaactgacgatattccagtatgggaccaagaattcttgaaggttgatcaaggtacattgttcgaattgatcttggccgctaactatttggacatcaagggtttgttagatgtaacatgtaaaaccgttgctaacatgatcaagggtaaaacaccagaagaaatcagaaagacctttaatattaagaatgatttcactgaagaagaagaagcacaagttagaaaggaaaaccaatggtgcggttctggt

SEQ ID NO: 193 - DNA, 2160 bp, Artificial Sequence
  codon-optimized
atgactgctgataataactctatgccacatggtgccgtatcttcatacgctaagttggttcaaaaccaaacacctgaagatatcttggaagaattcccagaaatcatccctttgcaacaaagaccaaacactagatccagtgaaacatccaacgatgaaagtggtgaaacctgtttttcaggtcatgacgaagaacaaattaaattgatgaacgaaaactgcatcgtattggattgggatgacaatgcaataggtgccggtactaagaaagtttgtcatttgatggaaaacatagaaaagggtttgttgcacagagctttctccgtttttatattcaatgaacagggtgaattgttattgcaacaaagagcaacagaaaagatcacctttccagatttgtggactaatacatgttgctctcatcctttgtgcattgatgacgaattaggtttgaagggtaaattggatgacaaaattaagggtgctataactgctgcagtcagaaaattagatcatgaattgggtataccagaagacgaaaccaagactcgtggtaaattccatttcttaaacagaatccactatatggctccatctaacgaaccttggggtgaacatgaaatcgattacatcttattttacaagattaatgcaaaggaaaacttgacagttaacccaaacgttaatgaagtcagagatttcaaatgggtttctcctaatgatttgaagaccatgtttgctgacccatcatataagtttactccttggttcaagatcatctgtgaaaactacttgtttaactggtgggaacaattagatgacttgtctgaagttgaaaacgatagacaaatccatagaatgttgaaattgtctggtggtggtggttctggtggtggtggttctggtggtggtggtagtgccgaagcttggtacaatttgggtaacgcttactacaagcagggtgactaccaaaaggcaatcgaatactaccaaaaggccttggaattggacccaaataacgcagaagcctggtataatttgggtaatgcatattataaacagggtgactatcaaaaggctattgaatattaccaaaaggcattggaattggaccctaataacgctgaagcatggtataatttgggtaacgcctattataagcagggtgactatcaaaaagccatcgaagactaccaaaaggctttggaattggatccaaacaacttacaagccgaagcttggaagaatttgggtaacgcttattacaaacagggtgactaccaaaaagctattgaatactatcaaaaagccttagaattagaccctaataacgcatctgcctggtacaatttgggtaatgcctattacaagcagggtgactatcagaaggctattgaatactaccaaaaagcattggaattggatccaaataacgctaaggcatggtacagacgtggtaatgcctattacaagcagggtgactatcaaaaggcgattgaagattatcaaaaagctttggaattggatcctaacaacagatctagatcagctggtggtggtggttctggtggtggtggttctggtggtggtggtgcttcttcatattaccatcaccatcaccatcacttagaatccacaagtttgtacaaaaaggctggttctggttcaaacaccgttaaggaattaaagaactacatccaagaattggaagaaagaaacgcagaattgaaaaatttgaaggaacatttgaagtttgccaaggctgaattagaattcgaattggccgctcacaaatttgaaggttccgctggtagtgcagccggttccggtgaattcggtagtgcagaagctgcagccaaagaagctgcagccaaggctggttctgcaggttcagctgcaggttctggtgaatttggttccagttactatcaccatcaccatcatcacttagaatccactagtttgtataaaaaggccggttctggttcacaaaaagtcgcacaattaaagaatagagtagcctacaagttgaaggaaaacgctaagttggaaaacattgtcgcaagattagaaaacgataatgccaacttggaaaaagacatcgctaatttggaaaaggatattgcaaacttggaaagagatgttgccagaggttctggt

SEQ ID NO: 194 - DNA, 2403 bp, Artificial Sequence
  codon-optimized
atggaagctaagatagatgaattgataaataacgacccagtttggtcttcacaaaacgaatccttgatcagtaagccatacaaccatatcttgttaaaacctggtaaaaatttcagattaaatttgatcgtacaaatcaacagagttatgaatttgcctaaggatcaattggctatcgtttctcaaatagtcgaattgttgcataactccagtttgttgatcgatgacatcgaagataacgcaccattgagaagaggtcaaactacatcccacttaatttggggtgtccctagtactattaataccgcaaactacatgtacttcagagccatgcaattggtatcacaattgaccactaaggaaccattgtaccattggttgatcacaatttttaacgaagaattgattaatttgcacagaggtcaaggtttggatatctattggagagacttcttaccagaaattatacctacccaagaaatgtacttgaacatggtaatgaataagactggtggtttgtttagattgaccttgagattaatggaagctttgtctccatcttcacatcacggtcattcattggttcctttcataaacttgttgggtatcatctatcaaatcagagatgactacttgaatttgaaggatttccaaatgtccagtgaaaagggtttcgcagaagacataactgagggtaaattgtcattcccaatcgtccatgccttaaacttcacaaaaaccaagggtcaaaccgaacaacacaatgaaatcttaagaattttgttattgagaacttctgataaggacataaagttgaagttgatccaaatcttggaattcgataccaactcattggcttacactaagaacttcatcaaccaattggttaacatgattaagaatgataacgaaaataagtacttgccagatttggcctcccatagtgacactgctacaaatttgcacgatgaattgttgtacatcatcgaccatttgtccgaattgaaattatctggtggtggtggttctggtggtggtggttctggtggtggtggtagtgcagaagcctggtacaacttgggtaacgcttactacaagcagggtgactaccaaaaggctatcgaatactaccaaaaggcattggaattagacccaaataacgctgaagcatggtacaacttaggcaacgcatattataaacagggtgactatcaaaaggccatagaatactaccaaaaggctttggaattggaccctaataacgccgaagcttggtacaacttgggtaatgcttattacaagcagggtgactatcaaaaagcaattgaagactaccaaaaagccttggaattagatccaaataacttgcaagcagaagcctggaagaacttaggcaacgcatactataaacagggtgactaccaaaaagccattgaatattatcaaaaagctttggaattagaccctaataacgcttctgcttggtataacttaggcaatgcctattataagcagggtgactatcagaaagctattgaatattatcaaaaggccttggaattggacccaaataacgccaaggcttggtacagacgtggtaacgcatactacaaacagggtgactatcagaaggctatcgaagattatcaaaaagcattagaattagatcctaataacagatctagatcagctggtggtggtggttctggtggtggtggttctggtggtggtggtgcttctttgtgtactatgaaaaagggtccatctggttacggttttaatttgcattctgataagtcaaagcctggtcaattcataagatcagttgatccagactcccctgcagaagccagtggtttgagagctcaagatagaattgtcgaagtaaatggtgtctgcatggaaggtaaacaacacggtgacgttgtttctgctattagagctggtggtgacgaaactaagttattggtagttgacagagaaggttccgccggtagtgctgcaggttctggtgaatttggttcagctgaagccgctgcaaaagaagccgctgcaaaggccggttctgctggttcagccgctggttctggtgaattcggttcttcatccggtgctataatctatacagttgaattgaagagatacggtggtccattaggtattactatatctggtacagaagaaccattcgatcctatcatcatcagttctttgactaagggtggtttagctgaaagaacaggtgcaatccatattggtgacagaatattggctatcaattcatccagtttgaaaggtaaaccattgtcagaagctatccacttattgcaaatggcaggtgaaaccgttactttgaaaatcaaaaagcaaacagatgcacaacctgcctcttcaggttctggt

SEQ ID NO: 195 - DNA, 2658 bp, Artificial Sequence
  codon-optimized
atgaatcatttgagagccgaaggaccagcttctgtcttagcaataggtactgccaatccagagaacatcttgttacaagatgaatttcctgactattacttcagagttaccaaatccgagcatatgacgcagttgaaggaaaagtttagaaagatctgtgataagagtatgatcagaaagaggaactgcttcttaaacgaagagcatttgaagcaaaatcctagattagtggaacacgagatgcaaacattggatgctaggcaggacatgttagttgtcgaagttcctaaattgggtaaagatgcatgtgccaaagctattaaggaatggggtcaacccaagtctaagataactcatttgatttttactagtgctagcactacagatatgcctggtgcagactatcactgtgccaaactacttggtttatcgccctctgtgaagagagttatgatgtatcaactaggttgctacggtggtggtactgtacttagaatcgctaaagacattgcagaaaataacaagggtgccagggtcttggctgtatgttgcgatattatggcttgcttgtttagaggtccatcagaatccgatttggagctgttggttggtcaagctattttcggtgacggtgctgcagctgttattgttggtgcagaacctgatgagtcagtcggtgaaagaccaatctttgaattggtttctaccggtcaaacgattttaccaaatagtgaaggtacaataggtggtcatatcagagaagctggtttgatattcgatttgcacaaagacgttcctatgctaatatctaacaacatcgaaaagtgtctgatcgaggcttttacccccatcggtatttccgattggaatagtatattctggatcacgcatccaggtggtaaagcaatcctggataaggttgaagagaagctgcatttgaagtctgataagtttgtcgacagcagacatgtattgtcggaacacggtaacatgtcttcatccacagtgctgttcgttatggatgaacttagaaagagatctttggaagagggtaaaagcaccacgggtgacggttttgaatggggtgttctttttggattcggccccggtttgaccgtcgaaagagtagttgttagatctgtaccaattaaatacaagttgtctggtggtggtggttctggtggtggtggttctggtggtggtggtagtgcagaagcctggtacaatttgggtaacgcttactacaagcagggtgactaccagaaggctatcgagtattaccaaaaagcacttgaactggatccaaataacgctgaggcatggtataatttgggcaacgcatattacaaacagggtgactatcaaaaggccatagaatactaccaaaaggctttggagctggatcctaataacgccgaagcttggtacaatttgggaaatgcctattataagcagggtgactatcagaaggcaatagaggactaccaaaaagccctagaacttgatccaaataatttgcaggcagaagcctggaagaatttgggtaatgcttactataaacagggtgactatcagaaagctattgaatactaccaaaaagcactggaattggatcctaataacgcttctgcttggtacaatttgggcaacgcttactacaaacagggtgactaccaaaaagctatcgaatattatcaaaaggctctggaactagatccaaataacgccaaggcttggtatagaaggggaaatgcttattataaacagggtgactaccagaaagcaattgaagactaccaaaaagcccttgaactggatcctaataacagatctagaagcgctggtggtggtggttctggtggtggtggttctggtggtggtggtgcttctggtaacaacttagaaacatacgagtggtacaataagtctatttctagagataaggccgaaaagttactacttgacaccggtaaagaaggtgcttttatggttagagattctagaactccaggtacttatacagtctctgtattcacaaaggctatcatctcagaaaacccatgtatcaagcattaccacatcaaggaaaccaacgactctcctaaaagatattacgtggcagaaaagtacgtttttgattcaatcccactgttgattcaatatcatcagtacaatggtggtggtttggtgactagattgaggtatcctgtttgcggtggtagcgcaggttcggctgcaggatcaggcgaatttggttccgccgaggccgctgcaaaagaagccgctgcaaaggctggatctgcaggctcagccgctggttctggagaatttggttctggttctcatccctggtttttcggtaaaattccaagagcaaaggccgaagaaatgttgtctaaacaaagacacgacggtgcatttttgataagggaaagtgagagcgcacctggtgacttttcgttgtctgttaaattcggtaatgatgtccaacatttcaaggtattgagagatggtgctggtaaatactttttgtgggtcgtaaagttcaattccttgaacgaattagtggattaccatagatcaacttccgttagtaggaaccaacagattttcttgagagatatcgaacaagttccacaacagcctacaggttctgga

SEQ ID NO: 196 - DNA, 2004 bp, Artificial Sequence
  codon-optimized
atggctgtaaagcatttgatcgtgttgaaattcaaggatgaaatcacagaggcacaaaaggaagagtttttcaagacctacgttaatttggtcaacataatcccagctatgaaagatgtatactggggtaaagacgtgacccaaaagaataaggaagagggttatacccatatagtagaagtgacgttcgaatcagttgaaactatccaagattacatcatacaccctgctcatgttggctttggtgacgtctacagatccttctgggaaaagttgctgatcttcgattacactccaagaaagaaattgtctggtggtggtggttctggtggtggtggttctggtggtggtggtagtgcagaagcctggtataatttgggaaacgcttattacaaacagggtgactaccaaaaggccatcgagtattaccaaaaagctcttgaactggacccaaataacgctgaggcatggtataatttgggtaacgcatactataagcaaggtgactaccaaaaggcaattgaatattaccaaaaggccttggagttagaccctaataacgccgaagcttggtacaatttgggtaatgcctactataaacagggtgactatcaaaaggctatagaggactaccagaaagcactagaacttgatcccaataacttgcaagcagaagcctggaagaatttgggtaatgcctattataagcaaggtgactatcaaaaagctattgaatactaccaaaaagctctggaattggaccctaataacgcttctgcttggtataatttgggtaatgcatactacaagcaaggtgactaccagaaggcaatagagtattaccaaaaagccttagaactagacccaaataacgccaaggcttggtacagaaggggtaatgcctactacaagcagggtgactaccaaaaagctattgaggactaccaaaaagcacttgaactggatcctaataacagatctagatcagctggtggtggtggttctggtggtggtggttctggtggtggtggtgcttccggtcaagatagaagtgaagccacattgattaaaagattcaaaggagaaggtgttagatacaaggctaagctgatcggtatcgatgaagtttctgctgctagaggtgacaaattgtgtcaagactctatgatgaagctgaagggcgttgtcgcaggtgccagatctaagggtgaacataagcaaaagatatttttgacgatctcattcggtggtattaaaatcttcgatgaaaagactggtgctttacaacatcaccatgcagtacacgaaatctcttacatcgctaaggatatcacagaccatagagcattcggttacgtttgcggtaaagaaggcaatcatagatttgtcgctattaaaaccgcccaagccgctgaaccagtcatcttggatttgagagacttattccagctaatctatgaactaaagcaaagagaagaattggaaaagaaagctggtagcgcaggatcggcagccggtagcggagaatttggttctgctgaggctgcagccaaagaagctgcagccaaggccggctctgctggttcagctgcaggctctggtgaatttggttctggttctcatatgggttctcaattttgggtaacttctcaaaagactgaagcttccgagagatgtggtttgcaaggctcctatattttaagggtggaagccgagaagcttaccctacttacgctgggtgcacagagtcaaatattggaacccctgttgttctggccatatactttattgagaagatacggtagagataaagttatgttcagtttcgaagctggtagaagatgcccaagcggtcctggaacttttacattccagacatcacaaggcaatgatatctttcaggcagttgaagccgctattcaacagcaaaaagcccagggtaaagtcggacaggctcaagacattctaagattggaacaccatcaccatcatcatggttctggt

SEQ ID NO: 197 - DNA, 2400 bp, Artificial Sequence
  codon-optimized
atgggtttgtcttcagtttgtacattctctttccaaacgaactaccatactttgctgaaccctcacaacaacaatcccaaaacttctttgctttgctacagacatccaaaaacccctattaagtatagctacaacaatttcccatcgaaacattgtagtactaagagcttccatttgcaaaataagtgctccgaatctttgtctatcgctaagaactcaattagagctgcaactacaaatcagacggaaccacctgagtcggataatcactctgtagccaccaaaattttgaactttggtaaagcttgttggaagctgcaaagaccatacacaataatagccttcacctcctgtgcttgcggtttgtttggtaaagaactgttgcataacacaaatttgatttcgtggtctttgatgttcaaggcatttttctttttggttgcaatcctttgcatcgcctcttttaccacgactattaatcaaatctatgatttgcacatcgacagaattaataagcccgatttgccactagcttcaggtgaaatctccgttaatactgcatggattatgtcaatcattgtcgccttgttcggtttaatcatcacaattaaaatgaaaggtggtccattgtacatcttcggctactgtttcggtatattcggtggtatagtatattccgttccaccttttagatggaaacaaaaccccagtaccgctttcttactaaatttcttggcacatatcatcacaaacttcaccttctactacgcttctagagctgctttgggtttgccattcgaattaagaccatcttttacatttttgctggcttttatgaaatcgatgggttctgcattggccttgattaaagatgcatctgacgttgaaggtgacacaaaattcggcatcagtaccttggctagcaagtacggttctagaaatttgactttgttttgttcaggtatcgtattgttatcctacgtggcagccattttagccggtatcatttggccacaagcttttaacagtaatgtcatgctacttagccacgcaatattggccttctggctgatcttgcagacgagagattttgctttaactaattatgaccctgaggcaggtagaagattctacgaattcatgtggaagctgtactacgctgaatatttggtttacgtctttattaagttgtctggtggtggtggttctggtggtggtggttctggtggtggtggtagtgctgaagcatggtacaacttaggcaacgcatactacaagcagggtgactaccagaaggcaattgagtattaccaaaaagccttagaactagacccaaacaatgccgaggcttggtataacttgggcaatgcttattacaaacagggtgactatcaaaaggctatagaatattaccaaaaggcacttgagctggaccctaacaatgcagaagcctggtataacttaggcaatgcttattacaagcagggtgactatcagaaggccatcgaggactaccaaaaggctttggaactggatccaaacaatttgcaggctgaagcatggaagaatttgggtaacgcttactataaacagggtgactatcagaaagcaatagaatactaccaaaaagccctagaacttgaccctaacaatgcctctgcttggtacaacttgggtaatgcttactataagcagggtgactaccaaaaagctatcgaatattaccaaaaagcactggaattggacccaaacaatgcaaaggcctggtatagaagaggtaacgcctactacaaacagggtgactaccaaaaggctattgaagattaccaaaaggctctggaactagatcctaacaacagatctagatccgctggtggtggtggttctggtggtggtggttctggtggtggtggtgcttctgcagaatacgttagagctctgttcgatttcaacggtaacgatgaagaggacttgccttttaagaaaggtgacattttgagaatcagggacaaaccagaagagcaatggtggaatgctgaagattctgagggtaaaagaggaatgattcctgttccctatgtcgaaaagtacggctcagcaggttccgctgcaggatctggcgaattcggttcagccgaggccgctgcaaaagaagccgctgcaaaggctggaagtgcaggcagcgccgctggttccggagaatttggtagtttgattaaacatatgagagccgaagctttattcgattttactggtaactccaaacttgaactgaatttcaaggcaggtgacgttattttcttgttgagtagaattaataaggactggttggaaggtactgttagaggtgctactggaatattcccactttcttttgtgaaaatcctgaagggctcaggt

SEQ ID NO: 198 - DNA, 1641 bp, Artificial Sequence
  codon-optimized
atgaaatgtagcactttttctttctggttcgtttgcaagatcattttctttttcttttcttttaatatccaaacttcgatcgcaaatccaagagaaaacttcttaaagtgtttctcacaatacattcctaataacgccacgaatttgaagctggtatacactcagaacaacccactgtacatgagcgtgctaaactcgacaatccataatttgagattcacttccgatactacacccaaaccattagtaatcgtgacaccttctcatgtttcacacattcaaggaaccatactatgctctaagaaagtcggtttgcagattagaacaaggtctggtggtcatgatagtgaaggcatgtcctacatcagtcaagttccattcgttatcgtcgatttgagaaacatgaggtctatcaaaatagacgttcactcacagacggcttgggtcgaggcaggtgccactttgggagaagtttactactgggtcaacgaaaagaatgaaaatttgtctcttgctgcaggttactgtccaactgtctgcgctggtggtcattttggtggtggtggttatggacctcttatgagaaactacggtttggccgctgataatatcattgacgcacatttggtaaatgtgcacggtaaagttctagatagaaagtcaatgggtgaagatttgttttgggcattgagaggtggtggtgctgaatcctttggtataatcgtagcttggaaaattagattggttgcagtcccaaagtctacaatgttctcagttaagaaaattatggaaatccatgagctggtaaagttggtgaataagtggcaaaacatcgcttacaagtacgataaggacttgctgctaatgacccatttcatcacgagaaacatcactgataaccagggtaaaaataagacagcaatacacacctacttctcttcagttttcttgggtggtgttgattccttagtggatttgatgaataagagtttccctgaactgggtattaagaaaactgattgtagacaattgagctggatcgacacaatcatattctatagtggtgttgtcaactacgatactgacaacttcaacaaagaaatccttctggatagaagtgccggacaaaatggcgctttcaaaattaagttggactacgttaaaaagcctatacccgagtcagtatttgtgcagatccttgaaaaactgtatgaagaggatattggtgctggaatgtacgcattatatccatacggtggtataatggatgaaatctccgagagtgccataccattccctcatagagctggtatcttgtacgaactgtggtacatatgttcttgggaaaaacaagaggataacgaaaagcacttaaactggatcaggaacatctataacttcatgactccttacgtttctaaaaaccccagattggcttatttgaattacagagatttggacataggtatcaacgatcctaaaaatccaaacaactacacacaagcaagaatttggggtgaaaagtacttcggtaaaaatttcgatagattggttaaagtcaagaccttagttgaccccaacaactttttcagaaacgaacaatctattccacctttgcctagacataggcacggctctggt

SEQ ID NO: 199 - DNA, 1644 bp, Artificial Sequence
  codon-optimized
atgaactgtagcactttttctttttggttcgtttgcaagataatatttttctttttgtcctttaatatccaaatcagtatcgccaacccacaggaaaactttttaaagtgtttctctgagtacatccccaacaacccagctaaccctaagtttatatatacacaacatgatcagctgtacatgagcgtattgaactcgaccattcaaaatttgagattcacttctgacactacacctaagcccttggtcatagtaactccttctaatgtctcacatatacaagcttctatcttgtgctctaagaaagttggtttgcagattagaacaaggtctggtggtcacgatgcagaaggtttatcctatattagtcaagtcccatttgccatagtagatttgagaaatatgcatactgtgaaagttgacatacactcacagactgcttgggtggaagcaggtgccacattgggagaggtttactactggatcaacgagatgaacgaaaactttagtttcccaggtggttactgtcccacagtcggtgttggtggtcatttttctggtggtggttatggagctttaatgagaaactacggtttggctgcagataatatcattgacgcacatttggtgaacgttgatggtaaagttcttgacagaaaatcaatgggtgaagatttgttttgggctatcagaggtggtggtggtgaaaatttcggtataatcgccgcttgcaaaattaagttggttgtcgtacctagcaaagctactattttctctgtcaaaaagaacatggaaatccatggtttagtaaagttgtttaataagtggcaaaacatcgcatacaagtacgataaggatttgatgcttaccacgcatttcagaactaggaacatcacagataaccatggtaaaaataagactacagttcacggatacttctcttcaattttcttgggtggtgttgattctcttgttgatttgatgaataagtcattcccagaactgggtattaaaaagacagattgtaaggaactgagctggatcgacaccacgattttctatagtggtgtggttaattacaacaccgccaacttcaaaaaggaaatcttgctggatagatccgctggtaaaaagaccgctttttctattaaacttgactacgttaagaaactgatccctgaaactgcaatggttaagatattggagaagctgtacgaagaggaagtcggcgtaggcatgtacgttttgtatccatacggtggtataatggatgagatctccgaaagtgccataccatttcctcatagagctggtatcatgtatgaattatggtacaccgctacgtgggagaagcaagaagataacgagaaacacataaactgggtcagatctgtatacaacttcactacaccttacgtttctcagaacccaagattggcatatttgaactacagagatttggacttgggtaaaaccaaccccgaatctccaaataactatacgcaagcaagaatttggggtgaaaagtacttcggtaaaaatttcaacagattggtgaaggttaagacaaaagccgatccaaacaacttctttagaaacgaacaatctattccaccattgccaccaagacatcatggttccggc

SEQ ID NO: 200 - DNA, 8232 bp, Artificial Sequence
  codon-optimized
atgtcagaagagtccttatttgaatcttcaccacaaaagatggagtacgaaatcactaactactctgagagacatacagaattgcctggacacttcatcggtttgaacacagttgacaagctggaagagtctccattgagagatttcgtcaagtcccatggtggtcacaccgtaattagtaagatcttgatagctaacaacggtatcgctgcagtcaaggaaattagatctgttagaaagtgggcatatgaaacctttggtgacgatagaacggtccaattcgtagctatggcaactcctgaagacttggaggccaatgctgaatatatcagaatggccgatcaatacattgaagttccaggtggtacaaataacaataactacgctaatgtcgacttaatagtagatatcgctgaaagagcagacgtggatgccgtttgggctggttggggacatgcttccgaaaaccctttgttacccgaaaaattgtctcagagtaagagaaaagttatttttattggtccacctggaaatgcaatgagatcattaggtgacaagatatccagtactatcgtggcacaatcagccaaagttccatgtattccttggtccggcaccggtgttgacacggtgcatgttgatgaaaagactggtttggtttctgtagatgacgatatctatcagaagggatgttgcacttcacctgaagatggtttgcaaaaggctaagagaatcggtttcccagttatgatcaaggcatcagaaggtggtggtggtaaaggtatcaggcaggtcgaaagagaagaggatttcatcgctctgtaccatcaagccgctaatgaaatacccggttctccaattttcataatgaaactagctggaagggcaagacatttggaagttcagctacttgctgaccaatacggcactaatatttccttgttcggtagagattgcagtgttcaaagaagacatcaaaagattatcgaagaggcaccagtcactatagcaaaagccgaaacatttcacgagatggaaaaggcagctgttagattgggtaaattggtcggatatgtaagtgctggaacagtcgaatatttgtacagccatgacgatggtaaattctactttttggaacttaacccaagattacaagttgagcaccctactacagaaatggtttctggtgttaatttgccagctgcacaactgcagattgctatgggtatccctatgcatagaatcagtgatatcaggactctgtacggtatgaatccacacagcgcttcggagattgacttcgaattcaaaactcaggatgcaactaagaaacaaagaagaccaatcccaaagggtcattgtaccgcttgcagaattacgtccgaagaccccaatgatggttttaaaccatctggtggtactttgcacgaactaaactttagaagctcgtctaatgtctggggttatttctcagtaggcaacaacggtaacatccattctttttcagattcccagttcggtcacatcttcgcatttggagaaaataggcaagcctctagaaagcatatggttgtcgctcttaaagaactgtcaatcagaggtgacttcagaaccacggttgaatacttaattaaactgttggaaactgaagacttcgaagataatacgattactacaggttggttggacgatttgataacccataagatgacggcagaaaaacctgatcccaccttggccgttatctgtggtgccgctacgaaggcctttttagcttctgaagaggctagacataagtacatagaaagcctgcaaaagggtcaggtactatcgaaagacttactacaaacaatgtttcctgtggatttcatccacgaaggtaaaagatacaagtttactgttgctaagtctggcaacgataggtacacgttgttcattaatggtagcaagtgcgacatcattctaagacaactttcagatggtggtttgctgatcgcaattggtggtaaatcacatactatctattggaaggaagaggtcgcagccacaagattgagtgtagacagcatgaccacgttgttagaggttgaaaacgatccaactcaattaagaacaccatctcctggtaaacttgtgaaatttctggttgaaaatggcgagcatataatcaagggtcaaccctacgctgagattgaagttatgaaaatgcagatgccattggtttctcaagaaaacggtatagttcaactacttaaacagcctggatcaaccatagtagctggtgacatcatggcaattatgacgttagacgatccatccaaggtgaaacatgctcttccttttgagggtatgctgcccgatttcggttctccagttattgaaggcactaaaccagcatacaagtttaaatcgttggtttctacactggaaaacatcctaaagggttacgataaccaagttattatgaatgcttctttgcaacagttgatagaagtcttgagaaatcctaagttaccctattcagaatggaaattgcatattagcgctcttcactcgagattgcctgcaaaattggatgaacaaatggaagagctagtcgctagatctttgagaagaggtgctgtatttccagcaaggcaattgagtaagctaattgacatggcagttaaaaacccagaatacaaccctgataaactgttgggtgccgtagtggaaccattggcagatattgcccataagtactctaatggtttagaagctcatgagcactcaatcttcgtgcatttcttggaagagtactacgaggttgaaaaattgttcaacggtcctaacgtcagagaagagaacatcatcctgaagttgagagatgaaaacccaaaggacttggataaagtcgctcttactgtactgagtcatagcaaggtttctgccaaaaataacttaatcctagctatcctgaagcactaccaacctttgtgtaagctgtcatccaaagtttctgcaatattttcaactccattgcaacatatcgtagagcttgaatctaaggctaccgcaaaagtggctttgcaggcaagagaaattttgatccaaggtgctttgccatcagttaaagaaagaacagagcaaatagaacacatcctgaagagtagcgttgtcaaagtcgcatacggttcgtctaatcctaagagatctgaacccgatttgaatatacttaaggatttgatcgattcaaattacgtagtgtttgacgttttactacagttcttaactcatcaagatcctgttgtcacagctgcagccgctcaagtctatataagaagggcctatagagcttacactatcggtgacattagggtacacgaaggcgtgacagttccaatcgtggaatggaaatttcaattgccctccgcagcctttagtaccttcccaacggtaaagtcaaaaatgggtatgaacagagctgtttctgtttctgatttgagctatgtggctaattcgcaatcatcccctttaagagaaggtattctaatggctgtggaccatttggacgatgttgatgaaattttgtctcaatctttggaagttattccaagacaccaaagtagctcgaatggtcccgctccagataggtctggatcttcagcaagtttaagcaacgtagccaatgtgtgtgttgcttccactgagggttttgaaagtgaagaggaaatcttggttagattgagagaaattttggatttgaacaaacaagaattgattaatgcttccatcagaaggatcacattcatgttcggttttaaagatggtagttaccctaagtactacacctttaatggtcccaactacaacgagaacgaaactatcagacatatcgaacctgccttagctttccaattggaactgggtagattgtcaaacttcaacatcaagccaattttcactgataacagaaacatccatgtgtacgaagctgtttcaaagacatccccattagataagagatttttcaccagaggcatcattaggacgggtcacattagagatgatattagcatacaagagtacttgacttcggaagctaacagattaatgtctgacatcctagataatttggaagttaccgacacgtcgaactctgatttgaaccatatctttattaacttcatcgcagtgttcgacatatctcctgaggatgttgaagctgcatttggtggtttcttggaaagattcggtaaaagattgctgagattgagagtctccagtgctgaaatcagaatcatcattaaggatccacaaactggtgcccctgtacccctgagagctttgatcaataatgtttctggttacgtaattaaaaccgagatgtacacggaagtcaagaatgctaagggtgaatgggtattcaagagcttgggtaaacccggctcgatgcacttaagaccaattgcaacaccatatcctgtcaaagaatggttgcaacctaagagatacaaagcccacttaatgggtactacatacgtttacgatttcccagaattgttcagacaggcttcttcttctcaatggaagaatttttccgccgacgttaagctgactgacgatttctttatcagtaacgaactaatcgaggatgaaaatggtgaacttacagaggttgaaagagagccaggagcaaatgccattggcatggtcgcttttaagatcactgtaaagacaccagaatatcctaggggtagacaattcgtagtggttgcaaacgacatcacctttaaaattggttctttcggacctcaagaagatgagtttttcaataaggttactgaatacgctaggaaaagaggtataccaagaatctacttggccgctaattctggagcaaggattggcatggccgaggaaatagtgcctttatttcaggttgcatggaacgacgcagccaacccagataagggattccaatatttgtatttgacttctgagggtatggaaacattgaaaaagttcgataaggaaaactcagtgctgaccgagagaactgttattaatggagaggaaaggttcgtaatcaaaactataatcggttctgaagatggtttgggcgtggagtgtctgagaggtagcggtttgattgctggtgcaacttctagagcttaccatgatatttttactatcacactggtcacttgcagatctgtaggcataggtgcttatttggttagattgggtcaaagggccatccaggtcgaaggccaacctattatattgactggtgcccccgctataaacaaaatgctgggtagagaagtttatacctccaatttgcagttgggtggtacgcaaatcatgtacaataacggtgtttctcatttgacagctgtagacgatttggctggtgtggaaaagattgttgaatggatgtcatatgtgccagctaaaagaaacatgcccgttccaatattggaaactaaggacacatgggatagaccagtagattttacccctacgaatgacgaaacctatgatgtgagatggatgattgagggtagggaaactgagtctggttttgaatacggtttgttcgataagggttctttctttgaaacattatcaggctgggccaagggtgtcgtagtgggaagagctagattgggtggtattcctctaggtgttattggtgtagaaactagaacagttgaaaatttgatccccgcagatccagccaaccctaattctgctgaaactttaattcaggaacctggtcaagtttggcatcccaactcagcttttaaaaccgcacaggccattaatgatttcaacaacggtgaacaattgccaatgatgatactggctaactggagaggtttttctggtggtcaaagggatatgttcaacgaagttttgaagtacggtagttttatcgtcgacgcactggtagattacaagcaacctatcataatatacattccaccaactggtgaattaagaggtggttcttgggttgtcgtagacccaaccattaacgcagatcagatggaaatgtacgccgatgtgaatgctagagcaggtgttttggaaccacaaggaatggttggtattaagtttagaagagaaaaattgctggatactatgaacagattagacgataagtacagggaattgagatctcaactgagcaataagtctttggctccagaagttcatcaacagatctctaagcaactggctgatagggaaagagaattgttgccaatatacggtcagatctcattgcaatttgccgacttacacgataggtcatccagaatggtggctaagggtgttatttcaaaagaattagagtggacagaagctagaagatttttcttttggagattgagaagaagattgaacgaggaatatttgattaaaagattgtcacatcaagttggcgaggcttctagattggaaaagatcgcaaggattagatcttggtatccagcatcagtcgatcacgaagacgatagacaagtagccacttggattgaggaaaattacaagacactggacgataagttgaagggtttaaagctagaatcctttgcccaagacttggctaaaaagattagaagtgaccatgataatgctatcgatggtttgagtgaagttattaaaatgcttagcactgacgataaggaaaaactgttgaagacattgaagaaactgtctggtggtggtggttctggtggtggtggttctggtggtggtggtagtgccgaagcttggtataacttgggaaatgcttattacaagcagggtgactaccaaaaggccatagaatactaccaaaaggctcttgagctggatcctaataacgcagaagcctggtataacttaggcaatgcatactataaacaaggtgactaccaaaaggcaatagagtactaccaaaaggccttggaattagatccaaataacgctgaggcatggtataacttgggcaacgcctactataaacagggtgactatcaaaaggctatagaagattaccagaaggcactagagcttgatcctaataacttgcaagccgaagcttggaagaacttaggaaatgcatactataagcaaggtgactatcaaaaagctattgaatattaccaaaaggctctggagttggatccaaataacgcatctgcttggtacaacttaggcaacgcctactataagcagggtgactatcaaaaagcaattgaatattatcaaaaggccttagagctagatcctaataacgctaaagcatggtataggagaggcaatgcatactacaaacagggtgactaccaaaaagctatagaagattaccaaaaggcacttgaactggatccaaataacagatctagatccgctggtggtggtggttctggtggtggtggttctggtggtggtggtgcttctggttctcatatgagattgggagcccaatctattcagccaaccgctaacttagatagaacggacgatttggtctatttgaatgtaatggaattggttagagctgttttggagttgaaaaatgaactagcacaattgccaccagaaggttacgtggttgtcgtaaagaatgttggtttgactcttagaaagttgataggctcggtcgacgatttgctaccatctttgccatcttcttctagaactgaaatagagggtacacaaaagcttctgaacaaagatttggctgaattgattaataagatgagattggcacaacagaacgccgttacttctttgtctgaggagtgtaagagacaaatgctaactgcttctcatactttggctgttgatgcaaagaacttgttagacgctgtggatcaagcaaaagttttagccaatttggctcacccacctgccgaaggttctgctggatcagctgcaggatccggcgaatttggttctgctgaagccgctgcaaaagaggctgctgcaaaagctggatctgcaggtagtgctgctggtagcggagaatttggttctggtgccatggctactcctggttcagaaaacgttctaccaagagaaccattgattgcaacagccgtgaagttcttgcagaactctagagttagacaatctccattggcaactagaagagcatttttgaaaaagaaaggtttgaccgacgaggaaattgatatggctttccaacagtccggtactgcagccgatgaaccatcttcattgtggggaagtggc

SEQ ID NO: 201 - DNA, 10869 bp, Artificial Sequence
  codon-optimized
atgggttctgctggttcagctgcaggttctggtgaattcggttccgctggtagtgccgctggttctggtgaatttggttctgctggttcagcagccggttctggtgaattctcctattaccatcaccatcaccatcacttggaatctacttcattatacaaaaaggctggttccggtagtgccagaaacgcttacttgagaaagaaaattgctagattgaagaaagataatttgcaattggaaagagatgaacaaaacttggaaaagattatcgctaatttgagagatgaaatagcaagattggaaaatgaagttgcttctcatgaacaaggttccgcaggtagtgccgccggttctggtgaatttgctgaagccgctgcaaaggaagccgctgcaaaagcaggttctgccggttcagccgctggtagtggtgaattttcttactatcaccatcaccatcatcacttggaatctacctcattatataaaaaggccggttccggtagtaacttggttgctcaattagaaaatgaagtcgcatcattggaaaacgaaaacgaaactttgaaaaagaaaaacttacataagaaagatttgatcgcttacttagaaaaggaaatagcaaatttgagaaagaaaatagaagaaggttccgctggtagtgcagccggtagtggtgaattcggttctgctgaagctgcagccaaggaagctgcagccaaagaagccgctgctaaagaagctgcagccaaagctggttctgcaggttctgccgcaggttccggtgaatttggttcttcatactatcaccatcaccaccaccacttggaatctacctcattatacaagaaagctggttccggtagtcaaaaggtcgctgaattgaaaaacagagtagctgttaagttgaacagaaacgaacaattgaaaaataaggtagaagaattgaaaaatagaaacgcttacttgaaaaacgaattggcaactttggaaaacgaagtagctagattagaaaacgatgttgctgaaggttctgctggttctgctgctggttctggtgaattcgctgaagcagccgctaaggaagcagccgctaaagccggttccgccggttctgctgcgggctctggtgaattttcctactatcaccatcatcatcaccacttggaatctacatcattatataagaaagccggttccggtagtaatgaagttactacattggaaaacgatgctgcttttattgaaaacgaaaacgcatacttagaaaaggaaatcgctagattgagaaaggaaaaggccgctttgagaaatagattagctcataagaaaggttctgctggtagcgctgctggctctggtgaatttggttccgccgaagccgctgctaaggaagccgctgccaaagaagccgctgccaaggaagccgctgctaaggctggttccgccggttcagctgcaggctctggtgaattcggttctagaccacctaccatctctaatccacctccattgatttccagtgctaaacatccatccgtcggtagtgcaggttccgctgccggctctggcgaatttgccgaagctgctgccaaagaagcagccgctaaagctggttcagcaggttccgctgccggatctggcgaattcaatttcttgcaatctagaccagaacctactgctcctccagaagaaagtttcagatctggtggttcagctggttccgccgcaggatctggcgaatttggttccgcagaagctgccgctaaagaagctgctgcaaaagaagcagccgccaaagaagctgctgcaaaagccggtagtgctggttcagctgccggttccggtgaattcggttcttcaaaaggtaccggtttaaatccaaacgctaaagtttggcaagaaattgctcctggtaacggttctgcaggttccgcagctggttccggtgaattcgccgaggccgctgctaaggaagcagcagccaaagcaggtagtgctggttccgcagctggttcaggtgaattcccagacggtggtaccactttcgaacatttgtggtccagtttagaacctgattctacatacggttctgccggttctgcagcaggcagcggtgaattcggttctgccgaagctgctgctaaagaagctgctgccaaggaagctgctgctaaggaagctgctgccaaagccggtagtgcaggttctgctgccggttcaggtgaatttggttcttcttactatcaccaccaccaccatcacttggaatctacatcattatacaagaaagccggttctggtagtaagagaatcgcatacttaagaaagaaaatcgctgcattgaagaaagataacgcaaacttagaaaaggacatcgctaacttggaaaacgaaatcgaaagattgattaaagaaatcaaaaccttggaaaatgaagttgcatctcatgaacaaggttcagccggttctgcagcgggctccggtgaatttgccgaagctgcagcaaaagaagctgccgctaaggctggtagtgctggttctgctgcaggcagcggtgaattttcttactaccaccatcaccaccatcacttggaatctacttcattatataagaaagcaggttctggtagtaacttgttagcaacattaagatctaccgctgcagtcttggaaaacgaaaaccatgtattggaaaaagaaaaggaaaaattgagaaaggaaaaagaacaattgttgaataagttggaagcttacaaaggttcagcaggttctgcagcgggctctggcgaattcggttccgccgaagctgcagcaaaggaagctgcagctaaagaggccgctgcaaaagaagctgctgccaaagcaggtagtgcaggttccgcagccggctccggcgaatttggttcaccagctacatcccaacatcctccacctccacctggtcatagatctcaagctccttcacatggttccgcaggtagtgcagctggatctggcgaattcgccgaagctgccgctaaggaagctgctgcaaaagctggttccgctggttcagcagcaggttccggtgaattcgaattgaattctttgttgatattgttagaagcagccgaatatttggaaagaagagatagaggttctgccggtagtgctgcaggtagcggcgaatttggttctgcagaagcagccgccaaggaagcagctgcaaaagaagcagcagctaaagaagcagctgcaaaagccggttctgctggttcagccgcaggatctggagaattcggttccagaccacctacaatttccaatccacctccattgatctcttctgccaagcatccatccgttggtagtgcaggttcagctgccggtagtggtgaatttgccgaagccgccgctaaggaagccgccgccaaagcaggttcagccggttccgccgcaggttcaggtgaattcaatttcttgcagtcaagaccagaacctaccgctcctccagaggagagtttcagatctggtggtagtgccggttcagctgccggctctggagaatttggttctgcagaggctgctgccaaggaagccgcagctaaagaagccgctgcgaaagaagccgccgctaaagctggtagtgcaggtagtgctgcgggatctggcgaattcggttcttctaagggtactggtttgaaccctaatgccaaggtctggcaagaaatcgcccctggtaacggttccgcaggttccgccgcaggtagtggtgaattcgccgaggctgccgccaaggaagccgccgctaaggcaggtagtgctggttcagcggccggctctggtgaatttccagacggtggtacaacctttgagcatttgtggtccagtttagaacctgattctacgtacggttctgctggttccgctgcaggatctggcgaattcggttccgcggaagccgccgcaaaagaagccgccgccaaagaagccgccgcaaaggaagccgcagcaaaggcaggtagtgccggctccgccgctggcagtggcgaatttggttcttcatattatcaccatcatcatcatcacttggaatctacttcattatacaagaaagcaggttccggttctaaaagaattgcttacttaagaaagaaaatcgcggctttgaagaaagacaatgctaacttagaaaaagatattgccaacttggaaaatgaaatcgaaagattaattaaggaaattaaaacattggaaaacgaagttgcatcacatgaacaaggttcagctggttccgctgcagggtccggcgaatttgcagaagccgccgccaaggaagccgcagccaaagctggtagtgcaggttctgccgctggctctggcgaattttcttactatcatcatcaccatcaccacttggaatctacttcattatacaagaaagcgggttcaggttctaacttgttagcaactttaagatctacagccgctgttttagaaaatgaaaaccatgtcttagaaaaagaaaaggaaaagttgagaaaggaaaaggaacaattattaaataagttagaagcctacaagggttcagcaggttccgcagcaggctcaggcgaatttggttctgcagaagcggctgctaaggaagctgccgcaaaggaagcagctgctaaggaggccgctgcaaaggctggttctgctggttccgccgcgggctctggagaattcggttccgctttggttgatgacgccgctgattatgaacctccaccttcaaataacgaagaagctttaggttccgctggttccgctgcaggttccggcgagttcgcagaagccgcagcaaaagaagccgcagctaaggcaggtagtgccggatccgccgctggcagtggagaattcagagaattgttcgatgacccatcttacgtcaacgtacaaaatttggataaagctagacaaggttccgccggttctgcagcgggatctggggaatttggttctgcagaagctgccgccaaagaagctgcagctaaagaagccgcagccaaagaagctgctgctaaggccggttctgctggttctgccgcaggatctggggaattcggttccaagaatactaagagtatgaacttcgataacccagtttacagaaagactacagaagaagaaggttcagccggttcagccgccggttccggtgaatttgcagaggctgccgctaaagaggctgccgctaaggccggtagtgctggttctgcagccggctccggagaattcagatctttgccatccacatggattgaaaacaaattatacggcatgtcagaccctaattggggttctgcaggttcagctgcgggatctggtgaattcggttcagcagaagccgcagccaaggaagccgctgcaaaggaggccgctgccaaagaagcagctgctaaggctggttcagccggttccgcagccggcagtggtgaatttggtagtgttgtcgataattctccacctccagctttgcctccaaagaaaagacaatctgctccatctggttcagcaggttcagccgctggttcaggtgaatttgccgaagcagctgccaaggaagctgccgccaaggcgggcagtgcaggttcggctgcggggtctggtgaattcactcaaagatctaaaccacaacctgcagttcctccaagaccatctgctgacttgattttaggttccgccggttccgcagctggctctggcgaattcggttccgctgaggctgccgctaaagaagcggccgctaaagaggcagccgctaaagaggcggccgctaaagcaggttctgcaggttcagcagcaggtagtggtgaatttggttctacagatgaagaaagagaagaaaccgaagaagaagtttatttgttgaactctaccactttgggttcagctggttctgctgcgggttctggcgaatttgcagaagcagctgctaaggaagccgcggcaaaggctggttctgcgggctccgccgcaggttctggtgaatttgatggtaatgtatctggtactcaaagattagactcagctaccgttagaacttattcatgcggttctgccggtagtgcagcgggctctggggaattcggttccgcagaagccgctgcaaaagaagccgctgcaaaagaagccgctgcgaaggaggctgctgctaaggcaggttccgccggtagtgctgcgggttccggcgaatttggttccagttactatcaccatcatcaccaccacttggaatccacaagtttatataagaaagctggttctggttcacaaaaggtagctcaattgaaaaatagagttgcatacaagttgaaggaaaacgctaagttggaaaacatagtagcaagattagaaaacgataacgctaatttggaaaaggacatcgcaaatttggaaaaggatatagctaacttggaaagagatgttgctagaggttctgctggtagtgccgcaggctctggcgaattcgctgaagctgccgctaaagaggctgcggctaaagctggttcagctggttctgcagcggggtctggtgaattttcttattatcaccatcatcaccatcacttggaatccaccagtttatacaagaaagccggctctggttcaaacactgttaaggaattgaaaaattacattcaagaattggaagaaagaaacgctgaattgaaaaatttgaaggaacatttgaagtttgcaaaagccgaattggaattcgaattagcagcccataaatttgaaggttctgccggttctgccgccggatctggagaatttggttctgcggaggctgccgctaaagaagccgccgctaaagaggctgcagctaaggaagctgcagcaaaggctggttctgccggttccgctgccggctccggcgaatttggttcacatgatgactccttgccacatcctcaacaagctacagatgactctggtcatgaatccgacggttccgcaggctctgctgccggctccggcgagtttgctgaagccgctgctaaagaggctgctgctaaagccggttctgccggttcagcagctggatctggagaatttggttccccaaatgctggtagtgttgaacaaaccccaaagaaacctggtttgagaagaagaggtagtgctggttctgccgctggctccggagaatttggttcagccgaagctgcggccaaagaggctgctgcaaaggaggctgcggctaaggaagccgccgctaaagccggttcagctggttccgcggcaggctccggggaatttggttcttcttattatcaccaccaccaccatcacttggaatccactagtttatacaagaaagcaggctctggttcattcgaaaacgtcactcatgaattcattttggcaaccttagaaaacgaaaacgctaagttgagaagattagaagcaaagttggaaagagaattggctagattaagaaatgaagtagcttggttgggttctgcgggctcggccgctggctctggtgaattcgccgaagctgcggccaaggaggctgccgcaaaggccggttctgccggttccgcagcgggatccggcgaattttcttactaccatcatcaccatcaccacttggaatccacaagtttatacaagaaagcgggttctggttcacaaaaagttgaagaattgaaaaataagatagcagaattggaaaacagaaacgctgtaaagaaaaatagagttgcacatttgaagcaagaaatcgcttacttgaaggatgaattagcagcccatgaattcgaaggtagtgccggttccgctgctggctcaggcgaatttggtagtgcagaagctgccgctaaggaggctgccgccaaagaagcagccgcaaaagaagctgccgcaaaagccggttctgcgggctctgctgccggatccggcgaattcggttcagtctccagtactaaattagtatcctttcatgatgacagtgatgaagacttgttacatatcggttctgcaggctcagccgctggctctggagagtttgcagaggcagctgctaaagaagccgccgcaaaggcaggttctgcaggttctgcagctggtagtggtgaattcgctgctgcaaccccaatatctacttttcatgatgactcagacgaagacttgttgcatgtcggttccgcaggttcagcagcgggatccggtgaatttggttcagcagaagctgccgccaaggaggccgctgctaaagaagcagcagccaaggaagcagcagcaaaggccggctctgctggttctgctgccgggtccggcgaatttggttcttcttattaccaccatcatcatcaccacttggaatccactagtttatataagaaagccggttctggttcacaaaaggtggaatcattaaaacaaaagattgaagaattgaagcaaagaaaagcacaattgaaaaatgatattgccaatttggaaaaggaaatcgcttacgcagaaacaggtagtgccggttcagccgcgggctctggtgaattcgcagaagctgccgcaaaagaagctgcagcaaaagccggttctgcaggctctgctgctggctctggcgaattttcctactatcatcatcatcatcatcacttggaatccacaagtttatacaagaaagcgggtagtgaatttttcagaagagaaagaaacaagatggcagccgctaagtgtagaaacagaagaagagaattgactgatacattacaagctgaaacagatcaattagaagacgaaaaatcagctttgcaaaccgaaatcgcaaatttgttgaaagaaaaagaaaaattggaattcattttagcagcccatagaccagcttgcaaaatacctgatgacttgggttttccagaagaaatgtctttagaaggtagtgccggtagtgccgctggctcaggtgaatttggtagtgcagaagctgccgcgaaagaagccgcagctaaagaagctgccgccaaagaggcagccgcaaaggcaggttcagcaggttcagctgccgggtccggggaatttggttcattccaaatgccagctgacactcctccacctgcatatttgccacctgaagatcctatgacaggtagtgccggttctgctgccgggtctggcgaattcgctgaagccgctgctaaggaggctgcagctaaggccggctctgcaggttccgctgcaggttcaggtgaatttgaaagagaatctaacgaagaaccacctccaccttatgaagatccatactggggtaatggtggttctgccggtagtgccgccggctcaggcgaatttggttctgcggaggctgctgcaaaggaagctgcggccaaggaagctgccgcaaaagaggctgctgccaaggccggttcagcaggttcagcagctgggtccggtgaatttggttccagttattatcaccaccatcatcaccacttggaatctacctcattatataagaaagcgggttccggtagtcaaaaagttgcagaattgaaaaacagagttgctgtcaaattaaatagaaatgagcagttgaaaaataaggtcgaggagttgaaaaatagaaacgcatacttgaaaaatgaattggctactttggaaaacgaagtcgcaagattagaaaatgatgtagctgaaggctctgctggttccgcagcgggctcaggtgaattcgccgaagcagccgcaaaggaagctgccgctaaggccggctcagcaggttctgccgccggaagcggtgaattttcttattaccaccaccaccatcaccacttggaatctacttcattatacaagaaagcggggtccggtagtaacgaagtcacaaccttagaaaatgatgcagcctttatagaaaacgaaaatgcctacttagaaaaagaaattgcaagattgagaaaggaaaaagctgcattgagaaacagattagcccacaagaaatcttactatcaccaccatcatcatcacttggaatctacatcattatacaagaaagcgggctccggtagtgctagaaatgcctacttaagaaagaaaatagccagattgaagaaagacaatttgcaattagagagagatgaacagaacttagaaaagattatagccaatttgagagatgaaattgctagattagaaaatgaagtagcttctcatgaacaaggtagtgctggctccgctgccggctccggagaatttgccgaagctgccgccaaggaagccgcggccaaggctggttccgctggttctgctgccggatctggagaattttcctattaccatcatcatcatcatcatttggaatctacatcattatacaagaaagcgggatctggttctaacttggtcgcccaattggagaacgaagtcgcatcattggagaacgaaaacgaaaccttgaagaaaaagaacttacacaaaaaggatttgatagcttacttagaaaaagaaatcgctaatttgagaaagaaaattgaagaaggtagtgcaggttcagccgctggctccggtgaatttggttcagcggaggctgccgctaaggaggcagccgctaaagaagcagccgctaaggaggctgcagcaaaagcaggttccgcaggttctgcagcgggttccggagaatttggttctgaacaaaagttgatctctgaagaagatttggaacaaaagttgatatctgaagaagacttggaacaaaaattaatatcagaagaagatttgggtagtgcaggttcagcagctggttctggagaatttggttcagcaggttctgccgctggaagtggcgaattcggtagtgccggctccgctgctggctctggcgaatttggttctggt

SEQ ID NO: 202 - DNA, 1365 bp, Artificial Sequence
  codon-optimized
atgggttctgctggttcagctgcaggttctggtgaatttggttccgcaggtagtgccgctggttctggtgaattcggttctgctggttcagcagccggttctggtgaattttcatattaccatcaccatcaccatcacttggaatccaccagtttatacaaaaaggctggttctggttcagctagaaacgcatatttgagaaagaaaattgctagattgaagaaagataacttgcaattggaaagagatgaacaaaatttggaaaagattatcgccaacttaagagatgaaatagcaagattggaaaacgaagtagcttctcatgaacaaggttccgcaggtagtgcagctggttctggtgaatttgctgaagccgctgcaaaggaagccgctgcaaaagctggttccgctggttcagccgctggttccggtgaattcagttactatcaccatcaccatcatcacttggaatccactagtttatataaaaaggccggttctggttcaaatttggttgctcaattagaaaacgaagtcgcatctttagaaaacgaaaacgaaacattgaaaaagaaaaatttgcataagaaagatttgatcgcttatttggaaaaggaaatcgcaaacttgagaaagaaaatagaagaaggttccgctggttctgctgctggttccggtgaatttggttcagctgaagctgcagccaaggaagctgcagccaaagaagccgctgctaaagaagctgcagccaaagcaggttctgccggttctgccgcaggttccggtgaattcggttcttcagctactagagaattggatgaattgatggcatccttaagtgacttcaagatacaaggtggttccgctggttctgcagccggctctggcgaattcgcagaagcagccgctaaggaagcagccgctaaagctggttctgcaggttctgctgccggttctggtgaattcgatttggctttgtctgaaaactgggcacaagaattcttggctgcaggtgacgctgttgatggttctgctggtagtgctgccggttcaggtgaatttggtagtgctgaagctgctgccaaagaagcagccgctaaagaagctgctgccaaggaagctgccgctaaagcaggttccgccggttctgccgccggctccggcgaatttggttcagattataaggatgacgatgacaaggattacaaagacgatgatgacaaggattataaagatgacgatgacaaaggttccgctggtagtgccgccggctctggagaattcggttctgccggttcagctgccggctccggagaatttggttccgctggtagtgcagccggttcaggtgaattcggttctggt

SEQ ID NO: 203 - DNA, 19104 bp, Artificial Sequence
  gene cassette
atgagtgctaaggcaatttctgaacaaactggtaaagaattgttgtacaagtttatttgtactacatcagccatccaaaatagattcaaatacgctagagttaccccagatactgactgggctagattgttacaagatcatccatggttgttatctcaaaacttggttgtcaaacctgaccaattaattaagagaagaggtaaattgggtttagtaggtgttaatttgacattggatggtgtaaagtcttggttgaaaccaagattaggtcaagaagccacagttggtaaagctaccggtttcttgaaaaatttcttgatcgaaccatttgtccctcattcacaagccgaagaattctatgtatgtatctacgctactagagagggtgactatgttttatttcatcacgaaggtggtgtcgacgtaggtgacgttgacgccaaggctcaaaagttgttggttggtgtcgatgaaaagttgaacccagaagacattaaaaagcatttgttggttcacgcacctgaagataaaaaggaaatattggcctcctttataagtggtttgtttaatttctacgaagatttgtacttcacctacttggaaattaacccattagtagttactaaggatggtgtatatgttttggacttagctgcaaaagttgatgcaacagccgactacatttgtaaggtcaaatggggtgacatcgaatttccacctccattcggtagagaagcttatccagaagaagcctacattgctgatttggacgctaagtctggtgcatcattgaagttgacattgttgaaccctaaaggtagaatttggaccatggttgctggtggtggtgctagtgtcgtatattctgatactatatgcgacttgggtggtgttaacgaattggcaaactacggtgaatactcaggtgccccatccgaacaacaaacatacgattacgctaagaccatcttgtccttaatgactagagaaaagcatcctgatggtaaaatcttgatcatcggtggtagtatcgcaaattttactaacgttgccgctacattcaagggtatcgtcagagctataagagattaccaaggtccattgaaggaacacgaagtaacaatattcgttagaagaggtggtcctaactaccaagaaggtttgagagtcatgggtgaagtaggtaaaaccactggtataccaatccatgtctttggtacagaaacccacatgactgcaatagttggtatggccttaggtcatagaccaatccctaatcaacctccaaccgcagcccacactgcaaatttcttgttaaacgcctctggttcaacttccacaccagctccttctagaacagcaagtttctctgaatcaagagctgatgaagtcgctccagctaagaaagcaaaaccagccatgcctcaagactccgttccaagtcctagatctttgcagggtaaatctactactttgttttctagacatactaaggctatagtatggggtatgcaaacaagagcagttcaaggcatgttggatttcgactatgtttgtagtagagatgaaccatctgttgctgcaatggtctatccttttactggtgaccataagcaaaaattctactggggtcacaaggaaatattgatcccagtttttaagaacatggccgatgctatgagaaaacatcctgaagtcgacgtattgattaacttcgcctcattaagatccgcttacgattctacaatggaaaccatgaactacgctcaaataagaaccatcgctatcattgcagaaggtattccagaagccttgactagaaagttgattaagaaagctgatcaaaaaggtgtcacaataatcggtccagctaccgtaggtggtattaagcctggttgtttcaagatcggtaacactggtggtatgttggataacatattggcatctaagttgtatagaccaggttcagtcgcttacgtatccagaagtggtggtatgtccaacgaattgaacaacatcatcagtagaactacagatggtgtatacgaaggtgttgctattggtggtgacagatacccaggttctacttttatggatcatgtattgagatatcaagacacacctggtgttaaaatgattgttgtcttgggtgaaataggtggtactgaagaatacaagatatgcagaggtatcaaagaaggtagattgacaaagccaatcgtttgttggtgcattggtacttgtgcaacaatgttttcttcagaagttcaattcggtcatgcaggtgcctgcgctaatcaagcttcagaaacagcagttgccaagaaccaagcattaaaagaagccggtgtttttgtccctagatctttcgatgaattaggtgaaatcattcaatcagtctatgaagacttggtagctaatggtgtaattgttccagcacaagaagttcctccacctactgtccctatggattactcttgggcaagagaattgggtttaattagaaagccagctagttttatgacctctatatgtgatgaaagaggtcaagaattgatctatgctggtatgcctattactgaagtattcaaagaagaaatgggtatcggtggtgttttaggtttgttgtggttccaaaagagattgccaaagtactcttgtcaattcattgaaatgtgcttaatggttacagctgatcatggtcctgctgtctcaggtgcacacaataccataatctgcgctagagctggtaaagatttggtttcttctttgacctcaggtttgttaactattggtgacagatttggtggtgcattagacgccgctgcaaagatgttttcaaaagctttcgattccggtataatcccaatggaattcgttaataagatgaaaaaggagggtaaattgataatgggtatcggtcatcgtgttaagtctatcaataaccctgatatgagagtacaaatcttgaaggactatgttagacaacactttccagccacacctttgttagattacgctttggaagttgaaaagattaccacttctaaaaagccaaatttgatcttgaacgttgatggtttaattggtgttgcttttgtcgacatgttgagaaactgtggttccttcactagagaagaagctgatgaatatatcgacattggtgcattgaatggtatctttgttttaggtagatctatgggtttcattggtcattacttggatcaaaagagattaaagcaaggtttgtacagacatccatgggatgacatttcttacgttttacctgaacacatgtcaatgaaattgtctggtggtggtggttctggtggtggtggttctggtggtggtggtagtgccgaagcttggtacaatttgggtaacgcatactacaagcagggtgactaccaaaaggcaattgaatattaccaaaaggccttggaattagacccaaataacgcagaagcctggtataatttgggtaatgcttattataaacagggtgactatcaaaaggctatcgaatactaccaaaaggcattggaattagaccctaataacgctgaagcatggtataatttgggtaacgcttattataagcagggtgactatcaaaaagccatcgaagactaccaaaaggctttggaattagatccaaataacttacaagccgaagcttggaagaatttgggtaacgcttactataaacagggtgactaccaaaaagcaattgaatactatcaaaaagctttagaattggaccctaataacgcatcagcctggtacaatttgggtaatgcttactataagcagggtgactatcagaaggccattgaatactatcaaaaggctttagaattggatccaaataacgctaaagcatggtacagacgtggtaacgcttattacaaacagggtgactaccagaaagccattgaagattatcaaaaggctttggaattggatcctaacaacagatctagatcagctggtggtggtggttctggtggtggtggttctggtggtggtggtgcttcttcatattaccatcaccatcaccatcacttggaatccacaagtttatacaaaaaggctggttctggttcaaatttggtcgcacaattggaaaacgaagtagcctctttagaaaatgaaaacgaaaccttgaaaaagaaaaacttacataagaaagatttgatcgcttatttggaaaaggaaatcgcaaatttgagaaagaaaattgaagaaggtagtgcaggttctgccgctggttctggtgaatttggttcagctgaagcagccgctaaggaagcagccgctaaagccggttcagctggttccgcagccggttctggtgaattcggttccagttactatcaccatcaccatcatcacttggaatccacaagtttatataagaaagcaggttctggttcagcaagaaatgcctacttgagaaagaaaatagctagattaaagaaagataacttgcaattggaaagagatgaacaaaatttggaaaagattatcgccaacttaagagatgaaatcgctagattggaaaatgaagttgcatcccatgaacaaggtagtggtgctactaacttctctttgttgaagcaagcaggtgacgttgaagaaaatccaggtccaatgaaaaactgtgtaatcgtttctgctgttagaactgcaattggttcctttaatggtagtttggcctctacatcagctattgatttgggtgctaccgtcatcaaagctgcaattgaaagagcaaagattgattctcaacatgtcgacgaagtaataatgggtaacgttttgcaagctggtttaggtcaaaatccagcaagacaagccttgttaaaatctggtttagcagaaactgtatgtggtttcacagttaataaggtctgcggttctggtttgaagtcagttgctttagccgctcaagctatacaagcaggtcaagcccaatctatcgtcgctggtggtatggaaaatatgtcattggcaccttatttgttagatgcaaaagccagatcaggttatagattaggtgacggtcaagtatacgacgttattttgagagatggtttaatgtgcgctactcatggttatcacatgggtattacagcagaaaatgttgccaaagaatacggtataaccagagaaatgcaagatgaattggcattacattcccaaagaaaggcagccgctgcaatcgaaagtggtgcttttactgcagaaattgtcccagtaaacgttgtcacaagaaagaaaactttcgttttctcccaagatgaattcccaaaagctaatagtaccgctgaagcattgggtgctttaagacctgcattcgacaaggccggtaccgtaactgccggtaatgcttctggtataaacgatggtgccgctgcattggttatcatggaagaatcagccgctttagcagccggtttgacacctttagctagaattaaatcttatgcatcaggtggtgttccacctgctttgatgggtatgggtccagtccctgctacccaaaaggcattgcaattagccggtttgcaattggctgatatcgacttaatcgaagcaaacgaagcctttgctgcacaattcttggcagttggtaaaaatttgggtttcgactccgaaaaggttaatgtcaacggtggtgccattgctttgggtcatccaataggtgcttcaggtgcaagaatcttggttacattgttgcatgccatgcaagctagagataaaaccttgggtttagctactttgtgtatcggtggtggtcaaggtatcgcaatggttatcgaaagattgaataagttgtctggtggtggtggttctggtggtggtggttctggtggtggtggtagtgcagaagcctggtacaatttgggtaacgcttactacaagcagggtgactaccaaaaggcaatcgaatactaccaaaaggccttggaattagatccaaataacgctgaagcatggtataatttgggtaatgcctattataaacagggtgactatcaaaaagctattgaatattaccaaaaggcattggaattagatcctaataacgccgaagcttggtataatttgggtaacgcctattataagcagggtgactatcaaaaggccatcgaagattaccaaaaggctttggaattggatccaaacaacttgcaagcagaagcctggaagaatttgggtaacgcttattacaaacagggtgactaccaaaaagctattgaatactatcaaaaagccttagaattggatcctaataacgcttctgcatggtacaatttgggtaatgcctactataaacagggtgactaccagaaggctattgaatactaccaaaaagcattagaattggatccaaataacgccaaggcttggtacagacgtggtaatgcctattacaagcagggtgactaccagaaagccatagaagactatcaaaaagccttggaattggatcctaacaacagatccagaagtgctggtggtggtggttctggtggtggtggttctggtggtggtggtgcttcttcatattaccatcaccatcaccatcacttggaatctacatcattatacaaaaaggctggttccggtagtaatgaagttactacattggaaaacgatgccgcttttatcgaaaacgaaaacgcatacttggaaaaggaaatcgccagattaagaaaggaaaaggcagccttgagaaatagattagcccataaaaagggttccgctggtagtgctgcaggttctggtgaatttggttcagctgaagccgctgcaaaagaagccgctgcaaaggcaggttctgccggttcagccgctggttctggtgaattcggttccagttactatcaccatcaccatcatcacttggaatctacttcattatataaaaaggccggttccggtagtcaaaaagtcgctgaattaaagaacagagtagctgttaagttgaacagaaacgaacaattgaaaaataaggtagaagaattgaaaaatagaaacgcctacttaaagaatgaattggcaacattggaaaacgaagtcgctagattggaaaatgatgtagcagaaggttctggtgctactaacttctctttgttgaagcaagcaggtgacgttgaagaaaatccaggtccaatgaaaaaggtttgtgtcattggtgctggtaccatgggttctggtatagcacaagcctttgctgcaaaaggtttcgaagttgtcttgagagatatcaaggacgaattcgttgatagaggtttggacttcatcaataagaacttgtctaagttggttaaaaagggtaaaatcgaagaagctacaaaggtagaaatcttgaccagaatttcaggtactgttgatttgaatatggccgctgattgtgacttggtaatcgaagcagccgttgaaagaatggatattaagaaacaaatcttcgcagatttggacaacatctgcaaacctgaaacaatcttagcctcaaacacctcttcattgtccattactgaagtcgctagtgcaacaaaaagaccagataaggtaataggcatgcatttctttaatccagctcctgttatgaagttggtagaagttattagaggtatagcaacatctcaagaaacctttgacgctgttaaggaaacttcaatagcaatcggtaaagatccagtcgaagtagccgaagctcctggtttcgtagttaacagaatcttgatacctatgatcaacgaagctgttggtatcttggctgaaggtattgcatctgtcgaagatattgacaaagccatgaagttaggtgctaatcacccaatgggtcctttggaattgggtgactttattggtttggacatatgtttagctatcatggacgttttgtattccgaaacaggtgacagtaaatacagaccacataccttgttgaagaaatatgttagagcaggttggttaggtagaaagtctggtaaaggtttctacgattactctaaaaagttgtctggtggtggtggttctggtggtggtggttctggtggtggtggtagtgcagaagcctggtacaatttgggtaacgcttactacaagcagggtgactaccaaaaggccatagaatactaccaaaaggctttggaattggatcctaataacgctgaagcatggtataatttgggtaatgcatattataaacagggtgactatcaaaaggcaatcgaatactaccaaaaggccttggaattagatccaaataacgccgaagcttggtataatttgggtaacgcctattataagcagggtgactatcaaaaagctatcgaagattaccaaaaggcattggaattggatcctaacaacttacaagcagaagcctggaagaatttgggtaacgcatattacaaacagggtgactaccaaaaagccattgaatattatcaaaaagctttggaattggatccaaataacgcttcagcatggtacaatttgggtaatgcctattacaagcagggtgactatcagaaagctattgaatattatcaaaaggctttggaattagatcctaataacgccaaggcttggtacagacgtggtaatgcctattacaagcagggtgactaccagaaggccattgaagactatcaaaaagccttggaattggatccaaacaacagatctagatcagctggtggtggtggttctggtggtggtggttctggtggtggtggtgcttccgaaaatttgtacttccaaggtgaaaacttgtacttccagggtgactccagtgaaagttgttggaattgcggtagaaaagcctccgaaacctgtagtggttgcaacactgctagatattgtggttctttttgccaacacaaagattgggaaaagcatcaccatatttgtggtcaaacattacaagcacaacaaggttctgccggttcagctgcaggttctggtgaatttggttccgctgaagccgctgcaaaagaagccgctgcaaaggcaggttccgccggtagtgccgctggtagtggtgaattcggttctatggcagtttccgaaagtcaattgaagaaaatggtttctaagtacaagtacagagatttgactgttagagaaacagttaacgtcatcactttgtacaaggatttgaagccagtcttggactcatacgtttttaatgatggttcttcaagagaattgatgaacttaactggtacaataccagttccttaccgtggtaacacttacaacatcccaatctgtttgtggttgttagatacatatccttacaatccacctatctgcttcgtcaaaccaacatccagtatgaccattaaaactggtaaacatgttgatgctaacggtaaaatatatttgccatacttacacgaatggaagcatcctcaatcagacttgttgggtttaatccaagtaatgatcgtcgtatttggtgacgaaccacctgttttctctagaccaggttcaggtgctactaacttctctttgttgaagcaagcaggtgacgttgaagaaaatccaggtccaatggaattgaacaacgttatattggaaaaggagggtaaagtcgctgttgtcactataaatagaccaaaggcattgaacgccttgaactctgatacattgaaggaaatggactacgttatcggtgaaattgaaaacgattcagaagtcttagcagtaattttgaccggtgccggtgaaaaatcctttgttgccggtgctgatatcagtgaaatgaaggaaatgaacactatcgaaggtagaaagttcggtatcttgggtaacaaggttttcagaagattggaattgttggaaaagcctgttatagctgcagtcaatggtttcgctttgggtggtggttgtgaaatcgcaatgtcctgcgatattagaatagcttcttcaaacgcaagatttggtcaaccagaagtcggtttaggtattacacctggtttcggtggtacccaaagattatctagattggttggtatgggtatggccaagcaattgatttttactgctcaaaacatcaaggctgatgaagcattgagaatcggtttggttaataaggtagttgaaccatctgaattgatgaacaccgccaaggaaatcgctaataagattgtttctaatgctccagttgctgtcaagttgagtaagcaagctataaatcgtggtatgcaatgtgatatcgacactgcattggccttcgaatctgaagcatttggtgaatgcttctcaacagaagatcaaaaagacgcaatgaccgcctttatcgaaaagagaaagatagaaggtttcaaaaacagaaagttatctggtggtggtggttctggtggtggtggttctggtggtggtggtagtgctgaagcatggtacaatttgggtaacgcttactacaagcagggtgactaccaaaaggcaatcgaatactaccaaaaggccttggaattggacccaaataacgccgaagcttggtataatttgggtaatgcctattataaacagggtgactatcaaaaagctatagaatactaccaaaaggcattggaattggaccctaataacgcagaagcctggtataatttgggtaacgcctattataagcagggtgactatcaaaaggccatagaagactaccaaaaggctttggaattggatccaaacaacttacaagctgaagcatggaagaatttgggtaacgcttattacaaacagggtgactaccaaaaagctattgaatattatcaaaaagctttagaattagaccctaataacgcctctgcttggtacaatttgggtaatgcctactataaacagggtgactaccagaaggctattgaatattaccaaaaagctttagaattggatccaaataacgcaaaggcctggtacagacgtggtaatgcctattacaagcagggtgactaccagaaagccattgaagattatcaaaaagctttggaattggatcctaacaacagatccagaagtgctggtggtggtggttctggtggtggtggttctggtggtggtggtgcttctggtccattgggttcccctttgactgcatcaatgttagcttccgcaccacctcaagaacaaaagcaaatgttgggtgaaagattattcccattgatacaagctatgcatcctactttagcaggtaaaatcacaggcatgttgttggaaatcgataactctgaattgttacacatgttagaatccccagaaagtttgagatctaaagttgacgaagccgtagctgttttgcaagctcatcaagcaaaagaagccgctcaaaaggccggttcagctggttccgcagccggtagtggtgaatttggttctgctgaagctgcagccaaagaagctgcagccaaggcaggtagtgccggttctgctgcaggttctggtgaattcggttccaataccaacatgagtgtcccaactgatggtgctgtaactacatctcaaattcctgcatcagaacaagaaactttagttagaccaaagcctttgttgttgaagttgttgaagtcagtaggtgctcaaaaagatacctacactatgaaggaagttttattttatttgggtcaatacatcatgacaaagagattatacgatgaaaagcaacaacatatcgtttactgttcaaacgatttgttgggtgacttgtttggtgtaccatctttctcagttaaggaacacagaaagatctatacaatgatatacagaaatttggtcgtaggttctggtgctactaacttctctttgttgaagcaagcaggtgacgttgaagaaaatccaggtccaatgatcgtaaagccaatggttagaaacaacatctgtttgaacgctcatcctcaaggttgcaaaaagggtgtagaagatcaaatcgaatacaccaaaaagagaatcactgcagaagttaaagccggtgctaaagcacctaagaatgttttggtcttaggttgttccaacggttatggtttggctagtagaataacagctgcatttggttacggtgccgctaccatcggtgtttccttcgaaaaggctggtagtgaaaccaaatatggtactccaggttggtacaataacttggcatttgatgaagcagccaagagagaaggtttatactctgtcactatagatggtgacgctttctcagatgaaatcaaggcacaagttattgaagaagccaaaaagaaaggtataaaattcgatttgatcgtttactccttagcaagtccagtcagaacagatcctgacaccggtataatgcataagtctgttttgaagccattcggtaaaactttcacaggtaaaacagtcgatcctttcaccggtgaattgaaagaaatatctgctgaaccagcaaatgatgaagaagctgcagccacagtaaaagttatgggtggtgaagactgggaaagatggatcaagcaattgtccaaagaaggtttgttggaagaaggttgtatcaccttagcttattcatacattggtcctgaagccactcaagctttgtatagaaaaggtacaatcggtaaagctaaagaacatttggaagccaccgctcacagattaaataaggaaaacccatctatcagagcatttgtttctgtaaataagggtttagttactagagcatccgccgttatcccagtcattcctttgtatttggctagtttgtttaaggttatgaaggaaaagggtaaccatgaaggttgcatagaacaaatcactagattgtacgcagaaagattatacagaaaggatggtacaattccagttgacgaagaaaacagaatcagaatcgatgactgggaattggaagaagatgtccaaaaggcagtatctgccttaatggaaaaagttaccggtgaaaacgctgaatcattgactgatttggcaggttatagacacgactttttagcctctaatggtttcgatgtcgaaggtattaactacgaagcagaagtagaaagattcgacagaattaaattgtctggtggtggtggttctggtggtggtggttctggtggtggtggtagtgctgaagcatggtataatttgggtaacgcttattacaagcagggtgactaccaaaaggccatcgaatactaccaaaaggctttggaattggaccctaataacgccgaagcttggtacaatttgggtaatgcctactataaacagggtgactatcaaaaagcaattgaatattaccaaaaggccttggaattagacccaaataacgcagaagcctggtacaatttgggtaacgcctactataagcagggtgactatcaaaaggctattgaagactaccaaaaggcattggaattagatcctaataacttgcaagctgaagcatggaaaaatttgggtaatgcctattataaacagggtgactaccaaaaagctattgaatactatcaaaaagctttggaattggacccaaataacgcctcagcttggtataatttgggtaatgcatactacaaacagggtgactatcagaaggcaatagaatactatcaaaaagccttagaattggatcctaataacgcaaaagcctggtatagacgtggtaatgcctactacaagcagggtgactatcagaaggcgatagaagattatcaaaaggcattggaattggatccaaacaacagatctagatcagctggtggtggtggttctggtggtggtggttctggtggtggtggtgcttcttcatattaccatcaccatcaccatcacttggaatccacaagtttatataagaaagcaggttctggttcaaatttgttagccactttgagatcaacagctgcagtattggaaaacgaaaaccatgttttggaaaaagaaaaggaaaagttgagaaaggaaaaggaacaattgttgaataagttggaagcctacaaaggttctgctggttcagccgctggttccggtgaattcggtagtgctgaagcagccgctaaggaagcagccgctaaagctggttccgcaggtagtgcagccggttctggtgaatttggttccagttactatcaccatcaccatcatcacttggaatccacaagtttatataagaaagctggttctggttcaaagagaatcgcatacttgagaaagaaaatcgctgcattaaagaaagataacgccaacttggaaaaggacatcgctaatttggaaaacgaaatcgaaagattgattaaagaaattaaaacattagaaaatgaagttgcttctcatgaacaaggttcaggtgctactaacttctctttgttgaagcaagcaggtgacgttgaagaaaatccaggtccaatgactagagaagttgtcgtagttagtggtgttagaacagctattggtacctttggtggttctttaaaagatgttgcaccagccgaattgggtgcattagtcgtaagagaagctttggcaagagcccaagtttcaggtgacgatgtcggtcatgttgtcttcggtaacgttatccaaacagaaccaagagatatgtatttgggtagagtagctgcagttaatggtggtgttaccataaacgctcctgcattaactgtcaacagattgtgtggtagtggtttacaagctattgtttctgccgctcaaacaatattgttaggtgacaccgacgttgctatcggtggtggtgctgaatctatgtcaagagccccatacttagctcctgcagccagatggggtgccagaatgggtgacgctggtttggttgacatgatgttgggtgctttgcatgatccattccatagaatccacatgggtgtaactgcagaaaacgttgccaaggaatacgatatctcaagagcacaacaagacgaagctgcattagaatcacacagaagagcatccgccgctattaaagccggttactttaaggatcaaatagttccagtagtttctaaaggtagaaagggtgacgttaccttcgatactgacgaacatgttagacacgacgctactattgatgacatgacaaagttaagacctgttttcgtcaaggaaaatggtactgttacagctggtaatgcatctggtttgaacgatgcagccgctgcagtcgtaatgatggaaagagccgaagctgaaagaagaggtttgaaaccattagctagattggtttcttatggtcatgctggtgtcgatcctaaagcaatgggtataggtccagttcctgctactaagatcgcattggaaagagccggtttacaagtctctgatttggacgtaattgaagccaatgaagcttttgccgctcaagcatgtgccgttacaaaagccttgggtttagatccagctaaggtcaatcctaacggtagtggtatctctttaggtcatccaattggtgcaaccggtgccttgataactgttaaggctttgcacgaattgaacagagtacaaggtagatatgcattagttacaatgtgcatcggtggtggtcaaggtattgcagccatattcgaaagaattaagttgtctggtggtggtggttctggtggtggtggttctggtggtggtggtagtgctgaagcatggtacaatttgggtaacgcttactacaagcagggtgactaccaaaaggcaatcgaatattaccaaaaagccttggaattagacccaaataacgccgaagcttggtataatttgggtaatgcctattataaacagggtgactatcaaaaagctatagaatactaccaaaaggcattggaattagaccctaataacgcagaagcctggtataatttgggtaacgcctattataagcagggtgactatcaaaaggccatagaagactaccaaaaggctttggaattggatccaaacaacttacaagctgaagcatggaagaatttgggtaacgcttattacaaacagggtgactaccaaaaagctattgaatactatcaaaaggctttagaattggaccctaataacgcctctgcttggtacaatttgggtaatgcctactataaacagggtgactaccagaaggctatcgaatattatcaaaaagctttagaattggacccaaataacgcaaaggcctggtacagacgtggtaatgcctattacaagcagggtgactaccagaaagctattgaagattatcaaaaggcattggaattggatcctaacaacagatccagaagtgctggtggtggtggttctggtggtggtggttctggtggtggtggtgcttctgatgttatgtgggaatataagtgggaaaatacaggtgacgctgaattatacggtccttttacttcagcacaaatgcaaacatgggtatccgaaggttatttccctgatggtgtttactgcagaaaattagacccacctggtggtcaattctacaactcaaagagaatagatttcgacttgtacaccggttcagctggttccgctgcaggttctggtgaatttggttccgcagaagccgctgcaaaagaagccgctgcaaaggctggtagtgcaggttctgccgctggtagtggtgaatttggttctgaatcagattccgtcgaattcaataacgctatatcttacgtaaataagattaaaaccagatttttagatcatccagaaatctatagatcattcttagaaatcttgcatacataccaaaaagaacaattgcacaccaagggtagacctttcagaggcatgtccgaagaagaagtctttactgaagtagctaatttgtttagaggtcaagaagatttgttgtcagaattcggtcaattcttgccagaagcaaaaagaggttccggtgctactaacttctctttgttgaagcaagcaggtgacgttgaagaaaatccaggtccaatgggtaaaaattacaagtcattggattccgttgtcgcaagtgactttattgccttgggtataacttctgaagtcgcagaaacattgcatggtagattagccgaaattgtatgtaactacggtgctgcaaccccacaaacttggatcaacatagcaaaccatatcttgtcaccagatttgcctttctccttgcaccaaatgttgttttatggttgctacaaggatttcggtcctgctccacctgcatggattccagaccctgaaaaggttaagtcaactaatttgggtgctttgttagaaaagagaggtaaagaattcttgggtgttaagtacaaggatccaatctcttctttttctcacttccaagaattttctgtcagaaaccctgaagtatactggagaacagttttgatggatgaaatgaaaataagtttctctaaggacccagaatgtatcttgagaagagatgacatcaacaacccaggtggttctgaatggttgccaggtggttatttgaactcagctaaaaattgcttgaacgttaactccaataagaaattgaatgatactatgattgtctggagagatgaaggcaacgatgacttgccattgaataagttgacattggatcaattgagaaagagagtttggttggtcggttacgcattagaagaaatgggtttggaaaaaggttgtgccatagctatcgatatgcctatgcatgtagacgctgtagttatctatttggctattgttttagcaggttacgtcgtagtttctatagctgattcattttccgcaccagaaatctcaactagattgagattatccaaagcaaaggccatattcacacaagatcacatcatcagaggtaaaaagagaatccctttatactcaagagtcgtagaagccaaatccccaatggctatagttatcccttgtagtggttctaacattggtgcagaattaagagatggtgacatatcttgggattactttttggaaagagccaaagaattcaagaattgcgaattcactgccagagaacaaccagttgatgcttacactaacattttgttctccagtggtactacaggtgaaccaaaagcaataccttggacacaagccacccctttaaaggccgctgcagatggttggtcacatttggatattagaaaaggtgacgtcatagtatggccaactaatttgggttggatgatgggtccttggttggtttatgctagtttgttaaatggtgcctctattgctttatacaacggtagtccattggtttctggtttcgctaaatttgtccaagatgcaaaagtaacaatgttgggtgttgtcccttcaatcgttagaagttggaagtctacaaattgtgtctcaggttatgattggtccaccatcagatgcttttcttcatccggtgaagcctctaatgtcgacgaatatttgtggttaatgggtagagctaactacaagccagttatcgaaatgtgtggtggtaccgaaattggtggtgcattctcagccggttcctttttacaagctcaatcattgagttctttttcatcccaatgtatgggttgcacattgtacatcttggataagaacggttacccaatgcctaaaaataagccaggtattggtgaattggctttaggtcctgttatgttcggtgcatctaaaacattgttgaacggtaaccatcacgatgtatacttcaagggtatgccaaccttaaatggtgaagttttgagaagacatggtgacatattcgaattaacctcaaacggttactaccatgcccacggtagagctgatgacactatgaacatcggtggtatcaaaatcagttctatcgaaatcgaaagagtatgtaacgaagttgatgacagagtctttgaaaccactgcaattggtgttccaccattgggtggtggtccagaacaattagtaatctttttcgttttgaaggattctaacgacacaaccatagatttgaaccaattgagattatcttttaacttgggtttacaaaagaaattgaacccattattcaaagttactagagtagttccattgtcatccttacctagaactgctacaaacaagattatgagaagagtcttgagacaacaattcagtcattttgaaggttctggt

SEQ ID NO: 204 - DNA, 18738 bp, Artificial Sequence
  gene cassette
atgaagttatctactaaattgtgttggtgcggtattaagggtagattaagaccacaaaagcaacaacaattgcataacacaaacttgcaaatgaccgaattgaagaaacaaaagactgctgaacaaaagactagaccacaaaacgttggtattaaaggtatccaaatctatatccctacacaatgtgtcaatcaatctgaattggaaaagtttgatggtgtatcacagggtaaatacactatcggtttaggtcaaacaaacatgtctttcgtaaacgatagagaagacatctattctatgtcattgactgttttgtccaagttgataaaaagttacaacatcgatacaaacaagattggtagattggaagttggtaccgaaactttgatcgataagtccaagagtgtcaagtctgtattgatgcaattgttcggtgaaaataccgatgttgaaggtatcgacactttaaatgcttgttatggtggtactaacgcattattcaattcattgaactggatcgaatccaatgcctgggatggtagagatgctattgttgtctgcggtgacatcgctatctatgacaaaggtgctgcaagaccaaccggtggtgcaggtactgttgccatgtggataggtccagatgcacctatcgtttttgactctgtcagagcatcatacatggaacatgcctacgatttctacaaaccagacttcacctccgaatatccttacgttgatggtcacttttctttgacttgttacgtcaaggctttggaccaagtatacaagtcttactctaagaaagcaatatctaagggtttggtttcagatccagctggttccgacgcattaaacgtcttgaagtacttcgattacaacgttttccatgtccctacatgcaagttggttaccaagtcttacggtagattgttgtacaacgatttcagagctaacccacaattgttccctgaagtcgacgctgaattagcaactagagattacgacgaatctttgacagataagaacatcgaaaagactttcgtaaacgttgcaaagccattccacaaagaaagagttgcccaatcattaattgtccctacaaataccggtaacatgtatacagcctcagtttacgccgcttttgcttccttgttaaattatgtaggtagtgatgacttgcaaggtaaaagagttggtttattctcctatggtagtggtttagcagcctctttgtactcttgtaagattgtaggtgacgttcaacacattattaaggaattggacatcactaataagttggctaagagaatcactgaaacaccaaaggattatgaagctgcaatcgaattgagagaaaacgcacatttgaagaaaaatttcaaacctcaaggtagtatagaacacttgcaatctggtgtctactacttaacaaacatcgatgacaaattcagaagatcatacgatgttaaaaagaaattgtctggtggtggtggttctggtggtggtggttctggtggtggtggtagtgctgaagcatggtataatttgggtaacgcttattacaagcagggtgactaccaaaaagcaatcgaatattaccaaaaggccttggaattagacccaaataacgccgaagcttggtacaatttgggtaatgcatactataaacagggtgactatcaaaaggctatcgaatactaccaaaaggcattggaattagaccctaataacgcagaagcctggtacaatttgggtaacgcctactataagcagggtgactatcaaaaagccatagaagactaccaaaaggctttggaattagatccaaataacttgcaagctgaagcatggaaaaatttgggtaatgcctactacaaacagggtgactaccaaaaggcaattgaatattatcaaaaagccttggaattagatcctaataacgcctcagcttggtataatttgggtaatgcctattataagcagggtgactaccagaaagccattgaatattatcaaaaggctttagaattggatccaaataacgcaaaagcctggtatagacgtggtaatgcctactacaagcagggtgactatcagaaggctattgaagattatcaaaaagctttggaattggatccaaacaacagatccagaagtgctggtggtggtggttctggtggtggtggttctggtggtggtggtgcttctttgggtcctttgccacctggttgggaagtaagatccacagttagtggtagaatctatttcgttgatcataacaacagaactacacaattcaccgacccaagattgcacggttctgctggttcagccgctggttctggtgaatttggttccgcagaagcagccgctaaggaagcagccgctaaagccggttccgctggtagtgcagccggtagtggtgaatttggttctggtgctatgggtccattaccacctggttgggaaaagagaacagattctaacggtagagtctacttcgtaaaccataataccagaattactcaatgggaagatcctagatctggttcaggtgctactaacttctctttgttgaagcaagcaggtgacgttgaagaaaatccaggtccaatggtagccgttagaagaaaggctttgtctatcttagccgaagctccagttttggcatcagatagattaccttacaagaactacgattacgacagagtatttggtgcttgttgcgaaaacgttattggttatatgccattgcctgtcggtgtaatcggtccattagttattgatggtacatcttaccatatccctatggcaactacagaaggttgtttggttgcatcagccatgagaggttgcaaggcaattaatgctggtggtggtgctaccactgttttaaccaaagatggtatgactagaggtccagttgtcagatttcctactttgaagagatccggtgcttgtaaaatatggttagatagtgaagaaggtcaaaatgccatcaaaaaggcttttaactccacaagtagattcgcaagattgcaacatattcaaacatgcttagccggtgacttgttgtttatgagattcagaacaaccactggtgacgctatgggtatgaatatgatatctaagggtgtcgaatactcattgaagcaaatggtagaagaatacggttgggaagatatggaagtagtttctgtttcaggcaactactgtactgacaaaaagccagctgcaattaactggatagaaggtcgtggtaaatctgtcgtagctgaagcaacaatacctggtgacgttgttagaaaggttttgaaatctgacgtatcagctttggttgaattgaacatcgctaaaaatttggttggttccgccatggctggtagtgtcggtggttttaatgcacatgccgctaacttagttacagcagtcttcttggccttaggtcaagatccagctcaaaacgtagaatcttcaaactgtatcaccttgatgaaagaagttgatggtgacttaagaatatccgttagtatgccatcaatagaagtcggtacaatcggtggtggtaccgtcttggaacctcaaggtgcaatgttagatttgttaggtgttagaggtccacatgcaactgcccctggtacaaatgctagacaattggcaagaattgtcgcttgtgcagtattagctggtgaattgtccttatgcgcagccttggctgcaggtcacttagttcaaagtcatatgacacacaacagaaagttgtctggtggtggtggttctggtggtggtggttctggtggtggtggtagtgccgaagcttggtataatttgggtaacgcatattacaagcagggtgactaccaaaaggccatcgaatactaccaaaaggctttggaattggacccaaataacgcagaagcctggtacaatttgggtaatgcttactataaacagggtgactatcaaaaggcaattgaatattaccaaaaggccttggaattagaccctaataacgctgaagcatggtacaatttgggtaacgcctactataagcagggtgactatcaaaaagctattgaagactaccaaaaggcattggaattagatccaaataacttgcaagccgaagcttggaaaaatttgggtaacgcttactacaaacagggtgactaccaaaaagctattgaatactatcaaaaagctttggaattggaccctaataacgcatctgcctggtataatttgggtaatgcttattataaacagggtgactaccagaaggcaatagaatactatcaaaaagccttggaattagacccaaataacgctaaagcatggtatagacgtggtaatgcttactataagcagggtgactaccagaaagctatagaagattatcaaaaggcattggaattggatcctaacaacagatctagatcagctggtggtggtggttctggtggtggtggttctggtggtggtggtgcttccagttattaccatcaccatcaccatcacttggaatccacaagtttatacaaaaaggcaggttcagaatttttcagaagagaaagaaataagatggccgctgcaaaatgtagaaacagaagaagagaattgacagataccttacaagctgaaaccgatcaattggaagacgaaaagtctgcattgcaaactgaaatagccaatttgttgaaggaaaaggaaaagttggaattcattttagccgctcatagaccagcttgcaaaattcctgatgacttgggtttcccagaagaaatgtctttagaaggttccgcaggtagtgcagccggttccggtgaatttggtagtgctgaagctgcagccaaggaagctgcagccaaagctggttctgcaggttcagctgcaggttccggtgaattcggttcttcatactatcaccatcaccatcatcacttggaatctacctcattatacaaaaaggctggttccggtagtcaaaaggttgaatctttgaagcaaaagattgaagaattgaagcaaagaaaagcccaattgaagaatgatatcgctaacttagaaaaggaaatcgcctacgctgaaactggttctggtgctactaacttctctttgttgaagcaagcaggtgacgttgaagaaaatccaggtccaatgagtttaccatttttgacatctgctcctggtaaagttattatattcggtgaacatagtgccgtctataataagccagctgtcgctgcatctgtatcagctttgagaacatacttgttgatctctgaatcttcagcacctgataccatcgaattggatttcccagacatctcattcaatcacaagtggtccattaatgatttcaacgctatcaccgaagaccaagtaaactcacaaaagttggccaaagctcaacaagcaactgatggtttgtcacaagaattagtttccttgttagacccattgttggctcaattgtccgaaagtttccattaccacgccgctttctgtttcttgtacatgttcgtttgtttatgccctcatgctaagaatatcaaattttctttgaagtctactttgccaattggtgcaggtttaggttccagtgcctctatatcagtttccttagcattggccatggcttatttgggtggtttgataggtagtaacgatttggaaaagttgtctgaaaacgacaagcatatcgtcaaccaatgggcattcatcggtgaaaaatgcattcacggtactcctagtggtatagataatgcagttgccacatatggtaacgctttgttattcgaaaaggactctcataacggtaccatcaacactaacaacttcaagttcttggatgactttcctgcaataccaatgatcttgacttacacaagaattccaagatctactaaagatttggtagctagagtcagagtattggttacagaaaagttccctgaagttatgaagccaatcttggatgcaatgggtgaatgtgccttgcaaggtttggaaatcatgacaaagttgtcaaagtgcaagggtactgatgacgaagctgttgaaacaaataacgaattgtacgaacaattgttggaattgatcagaatcaatcatggtttgttagtttcaattggtgtctcccacccaggtttagaattgataaagaacttgtcagatgacttaagaatcggttccacaaaattgaccggtgctggtggtggtggttgttctttgaccttgttaagaagagatatcactcaagaacaaatcgacagttttaaaaagaaattgcaagatgacttctcttacgaaactttcgaaacagatttgggtggtactggttgttgcttgttgtcagctaagaatttgaacaaagatttgaagattaaatccttggttttccaattgttcgaaaataagactacaaccaagcaacaaatcgatgacttgttgttgcctggtaatacaaacttgccatggacctcaaaattatctggtggtggtggttctggtggtggtggttctggtggtggtggtagtgctgaagcatggtataatttgggtaacgcatattacaagcagggtgactaccaaaaggctatcgaatactaccaaaaggcattggaattggaccctaataacgccgaagcttggtacaatttgggtaatgcttactataaacagggtgactatcaaaaggccattgaatattaccaaaaggctttggaattggacccaaataacgcagaagcctggtacaatttgggtaacgcttactataagcagggtgactatcaaaaagcaattgaagactaccaaaaggccttagaattggatcctaataacttgcaagctgaagcatggaaaaatttgggtaacgcttattataaacagggtgactaccaaaaagccattgaatactatcaaaaagcattggaattggatccaaataacgcctctgcttggtataatttgggtaatgcttattataagcagggtgactaccagaaagccatagaatactatcaaaaagctttggaattagaccctaataacgcaaaagcctggtatagacgtggtaatgcttactacaaacagggtgactatcagaaggcaatagaagattatcaaaaagctttagaattagacccaaataacagaagtagatctgctggtggtggtggttctggtggtggtggttctggtggtggtggtgcttctatggaacctgcaatggaaccagaaacattggaagccagaatcaatagagctaccaatcctttgaacaaggaattggattgggcttctattaatggtttctgtgaacaattgaacgaagacttcgaaggtccacctttagcaacaagattattggcccataaaattcaatcaccacaagaatgggaagcaatacaagccttaaccgtcttggaaacttgtatgaagtcctgcggtaaaagattccacgatgaagttggtaaattcagatttttgaacgaattgatcaaggttgtctcacctaagtatttgggtagtagaacatctgaaaaggttaaaaacaagatcttggaattgttgtactcctggaccgtaggtttaccagaagaagttaagatcgctgaagcataccaaatgttgaagaaacaaggtattgttaagtcaggttccgccggtagtgcagccggttctggtgaattcggttctgcagaagctgcagccaaggaagctgcagccaaagctggttcagcaggttccgctgcaggttctggtgaatttggttcaggtgcaatgggttccatggccgaagctgaaggtgaaagtttggaatcttggttaaataaggctacaaatccatcaaacagacaagaagattgggaatatatcattggtttctgtgaccaaatcaataaggaattggaaggtcctcaaatagctgttagattattggcacataagatccaatctccacaagaatgggaagccttacaagctttgactgttttagaagcttgtatgaagaattgcggtagaagatttcacaacgaagtcggtaaattcagatttttgaatgaattaattaaggtagttagtccaaaatacttaggtgacagagtttctgaaaaggttaagaccaaagtcatagaattgttgtactcttggactatggccttgcctgaagaagctaagatcaaagatgcataccatatgttgaagagacaaggtatagtccaatcagatccacctatcccagtagacagaactttgattccatctccaccaccaagacctaaaaatggttccggtgctactaacttctctttgttgaagcaagcaggtgacgttgaagaaaatccaggtccaatgtccgaattaagagcttttagtgcacctggtaaagccttgttagctggtggttatttggttttggatacaaagtacgaagcattcgttgtcggtttgtcagccagaatgcatgcagtcgcccacccttacggttctttacaaggttctgataagttcgaagtaagagtcaagtctaagcaattcaaggacggtgaatggttataccatatatctccaaagtcaggttttattcctgtttccataggtggtagtaaaaatccattcatcgaaaaggttattgcaaacgtcttttcttacttcaagcctaacatggatgactactgtaacagaaacttgttcgtcatcgatatattctctgatgacgcttatcattctcaagaagactcagtaactgaacacagaggtaatagaagattgtcctttcatagtcacagaattgaagaagttccaaaaaccggtttaggttcttcagctggtggtttagtcactgtattgactacagctttagcatcctttttcgttagtgatttggaaaacaacgtagacaagtacagagaagttattcataatttggcacaagtagcccactgccaagcacaaggtaaaatcggttccggttttgatgttgctgcagccgcttatggttcaattagatacagaagattcccacctgctttgatatctaatttgccagatatcggttctgctacatatggttcaaagttggcacatttggttgatgaagaagactggaacatcacaattaaatccaaccatttgcctagtggtttgaccttatggatgggtgacattaagaatggttctgaaactgttaagttggtccaaaaagtaaagaactggtacgattctcatatgccagaatcattgaagatctacacagaattagaccatgctaattccagattcatggatggtttgagtaaattagacagattgcatacccacgatgactactctgatcaaatcttcgaatcattggaaagaaacgactgtacttgccaaaaatacccagaaatcacagaagtaagagatgccgttgctaccataagaagatcttttagaaagatcactaaggaatcaggtgcagatatcgaaccacctgttcaaacatctttgttagatgactgtcaaaccttgaagggtgtcttaacttgcttgattccaggtgctggtggttatgatgcaatagccgtcatcactaaacaagatgtagacttgagagctcaaacagcaaacgataagagattttcaaaggtccaatggttagatgtaacccaagctgactggggtgttagaaaagaaaaggatcctgaaacttacttggacaaaaagttatctggtggtggtggttctggtggtggtggttctggtggtggtggtagtgctgaagcatggtacaatttgggtaacgcatactacaagcagggtgactaccaaaaggccatagaatactaccaaaaggctttggaattggacccaaataacgccgaagcttggtataatttgggtaatgcttattataaacagggtgactatcaaaaggcaatcgaatactaccaaaaggccttggaattagaccctaataacgcagaagcctggtataatttgggtaacgcttattataagcagggtgactatcaaaaagctatcgaagactaccaaaaggcattggaattagatccaaataacttgcaagctgaagcatggaagaatttgggtaacgcttactataaacagggtgactaccaaaaagccattgaatattatcaaaaagctttggaattggatcctaataacgcctctgcttggtacaatttgggtaatgcttactataagcagggtgactatcagaaggctattgaatattatcaaaaggctttagaattggaccctaataacgcaaaggcctggtacagacgtggtaacgcttattacaaacagggtgactaccagaaagctattgaagattatcaaaaggcattggaattggatcctaacaacagatccagaagtgctggtggtggtggttctggtggtggtggttctggtggtggtggtgcttccagttattaccatcaccatcaccatcacttggaatctacatcattatacaaaaaggctggttccggtagtcaaaaggttgaagaattgaaaaataagatagccgaattggaaaacagaaacgctgttaaaaagaacagagtcgcacatttgaaacaagaaatagcctacttgaaggatgaattagcagcccatgaatttgaaggttctgccggttcagctgcaggttctggtgaattcggttcagctgaagccgctgcaaaagaagccgctgcaaaggccggttccgctggtagtgccgctggttctggtgaatttggttcttcatactatcaccatcaccatcatcacttggaatctacttcattatataaaaaggccggttccggtagtttcgaaaacgttacacatgaattcattttggctaccttggaaaacgaaaacgcaaagttaagaagattggaagccaagttggaaagagaattagctagattgagaaatgaagttgcatggttaggttctggtgctactaacttctctttgttgaagcaagcaggtgacgttgaagaaaatccaggtccaatgacagtttataccgcttctgtcaccgcacctgtaaatattgctactttgaaatactggggtaaaagagatactaagttgaatttgccaacaaactcttcaatctcagttacattgtcccaagatgacttaagaaccttgacttctgctgcaactgctcctgaattcgaaagagatacattgtggttgaatggtgaaccacattctatcgacaacgaaagaactcaaaactgtttgagagatttgagacaattgagaaaggaaatggagagtaaggatgcttctttgcctacattgagtcaatggaagttgcacatagtttctgaaaacaacttcccaaccgccgctggtttggcatccagtgcagccggtttcgctgcattagtctctgcaatcgccaagttgtaccaattgccacaaagtacatctgaaatcagtagaatcgctagaaaaggttcaggttccgcatgtagatctttatttggtggttacgtcgcatgggaaatgggtaaagccgaagacggtcatgattcaatggccgtacaaatagctgactcttcagattggcctcaaatgaaagcttgcgtcttggttgtctcagacatcaaaaaggatgtatccagtacacaaggcatgcaattgactgttgcaacatccgaattgtttaaagaaagaatcgaacacgtagttccaaaaagattcgaagtcatgagaaaggctatcgtagaaaaggatttcgccaccttcgctaaggaaactatgatggacagtaactctttccatgcaacttgtttggattcatttccacctattttctatatgaacgacacctcaaagagaataatctcctggtgccacactatcaaccaattctacggtgaaacaatcgttgcttacaccttcgatgcaggtcctaatgccgtcttgtattacttagccgaaaacgaatcaaagttgttcgcttttatatataagttgtttggttccgttccaggttgggataaaaagttcactacagaacaattggaagcttttaatcatcaattcgaatcttcaaactttactgccagagaattggacttagaattgcaaaaggatgtagctagagttatcttgacccaagttggttcaggtcctcaagaaactaacgaatccttgatagatgctaagacaggtttgccaaaagaaaaattgtctggtggtggtggttctggtggtggtggttctggtggtggtggtagtgctgaagcatggtataatttgggtaacgcttattacaagcagggtgactaccaaaaggccatcgaatactaccaaaaggctttggaattggaccctaataacgccgaagcttggtacaatttgggtaatgcctactataaacagggtgactatcaaaaagcaattgaatattaccaaaaggccttggaattggacccaaataacgcagaagcctggtacaatttgggtaacgcctactataagcagggtgactatcaaaaggctatcgaagattaccaaaaggcattagaattggatcctaataacttgcaagctgaagcatggaaaaatttgggtaatgcctattataaacagggtgactaccaaaaagctattgaatactatcaaaaagctttagaattagacccaaataacgcctcagcttggtataatttgggtaatgcatactacaaacagggtgactatcagaaggcaattgaatactatcaaaaggcattagaattagatcctaataacgcaaaagcctggtatagacgtggtaatgcctactacaagcagggtgactatcagaaggcgattgaagactaccaaaaggcattggaattggatccaaacaacagatcaagatccgctggtggtggtggttctggtggtggtggttctggtggtggtggtgcttctgcaatggccgatttggaacaaaaggtattggaaatggaagctagtacatatgacggtgtttttatttggaagatctctgatttcccaagaaaaagacaagaagctgttgcaggtagaatccctgctatttttagtccagcattctacacctctagatacggttacaagatgtgtttgagaatatatttgaatggtgacggtactggtagaggtactcatttgtctttgtttttcgtcgtaatgaagggtcctaatgatgctttgttgagatggccttttaatcaaaaggttaccttgatgttgttggatcaaaacaacagagaacacgttatcgacgcttttagacctgatgtcacttccagttctttccaaagaccagttaatgatatgaacattgcttctggttgtcctttgttttgcccagtctcaaagatggaagctaaaaattcctatgttagagatgacgccatcttcattaaggctatcgttgatttgactggtttaggttcagcaggttccgccgctggttctggtgaatttggttccgccgaagcagccgctaaggaagcagccgctaaagcaggtagtgccggttctgcagccggctctggcgaatttggtagtgcctctattaaattgcaatcatccgacggtgaaatcttcgaagttgatgtcgaaatagcaaagcaatctgttaccataaaaactatgttggaagatttgggtatggatgacgaaggtgacgatgatccagttcctttgccaaatgtcaacgctgcaatattgaagaaagttattcaatggtgcacacatcacaaggacgatccacctccacctgaagacgatgaaaataaggaaaagagaactgacgatattccagtatgggaccaagaattcttgaaggttgatcaaggtacattgttcgaattgatcttggccgctaactatttggacatcaagggtttgttagatgtaacatgtaaaaccgttgctaacatgatcaagggtaaaacaccagaagaaatcagaaagacctttaatattaagaatgatttcactgaagaagaagaagcacaagttagaaaggaaaaccaatggtgcggttctggtgctactaacttctctttgttgaagcaagcaggtgacgttgaagaaaatccaggtccaatgactgctgataataactctatgccacatggtgccgtatcttcatacgctaagttggttcaaaaccaaacacctgaagatatcttggaagaattcccagaaatcatccctttgcaacaaagaccaaacactagatccagtgaaacatccaacgatgaaagtggtgaaacctgtttttcaggtcatgacgaagaacaaattaaattgatgaacgaaaactgcatcgtattggattgggatgacaatgcaataggtgccggtactaagaaagtttgtcatttgatggaaaacatagaaaagggtttgttgcacagagctttctccgtttttatattcaatgaacagggtgaattgttattgcaacaaagagcaacagaaaagatcacctttccagatttgtggactaatacatgttgctctcatcctttgtgcattgatgacgaattaggtttgaagggtaaattggatgacaaaattaagggtgctataactgctgcagtcagaaaattagatcatgaattgggtataccagaagacgaaaccaagactcgtggtaaattccatttcttaaacagaatccactatatggctccatctaacgaaccttggggtgaacatgaaatcgattacatcttattttacaagattaatgcaaaggaaaacttgacagttaacccaaacgttaatgaagtcagagatttcaaatgggtttctcctaatgatttgaagaccatgtttgctgacccatcatataagtttactccttggttcaagatcatctgtgaaaactacttgtttaactggtgggaacaattagatgacttgtctgaagttgaaaacgatagacaaatccatagaatgttgaaattgtctggtggtggtggttctggtggtggtggttctggtggtggtggtagtgccgaagcttggtacaatttgggtaacgcttactacaagcagggtgactaccaaaaggcaatcgaatactaccaaaaggccttggaattggacccaaataacgcagaagcctggtataatttgggtaatgcatattataaacagggtgactatcaaaaggctattgaatattaccaaaaggcattggaattggaccctaataacgctgaagcatggtataatttgggtaacgcctattataagcagggtgactatcaaaaagccatcgaagactaccaaaaggctttggaattggatccaaacaacttacaagccgaagcttggaagaatttgggtaacgcttattacaaacagggtgactaccaaaaagctattgaatactatcaaaaagccttagaattagaccctaataacgcatctgcctggtacaatttgggtaatgcctattacaagcagggtgactatcagaaggctattgaatactaccaaaaagcattggaattggatccaaataacgctaaggcatggtacagacgtggtaatgcctattacaagcagggtgactatcaaaaggcgattgaagattatcaaaaagctttggaattggatcctaacaacagatctagatcagctggtggtggtggttctggtggtggtggttctggtggtggtggtgcttcttcatattaccatcaccatcaccatcacttagaatccacaagtttgtacaaaaaggctggttctggttcaaacaccgttaaggaattaaagaactacatccaagaattggaagaaagaaacgcagaattgaaaaatttgaaggaacatttgaagtttgccaaggctgaattagaattcgaattggccgctcacaaatttgaaggttccgctggtagtgcagccggttccggtgaattcggtagtgcagaagctgcagccaaagaagctgcagccaaggctggttctgcaggttcagctgcaggttctggtgaatttggttccagttactatcaccatcaccatcatcacttagaatccacaagtttgtataaaaaggccggttctggttcacaaaaagtcgcacaattaaagaatagagtagcctacaagttgaaggaaaacgctaagttggaaaacattgtcgcaagattagaaaacgataatgccaacttggaaaaagacatcgctaatttggaaaaggatattgcaaacttggaaagagatgttgccagaggttctggtgctactaacttctctttgttgaagcaagcaggtgacgttgaagaaaatccaggtccaatggaagctaagatagatgaattgataaataacgacccagtttggtcttcacaaaacgaatccttgatcagtaagccatacaaccatatcttgttaaaacctggtaaaaatttcagattaaatttgatcgtacaaatcaacagagttatgaatttgcctaaggatcaattggctatcgtttctcaaatagtcgaattgttgcataactccagtttgttgatcgatgacatcgaagataacgcaccattgagaagaggtcaaactacatcccacttaatttggggtgtccctagtactattaataccgcaaactacatgtacttcagagccatgcaattggtatcacaattgaccactaaggaaccattgtaccattggttgatcacaatttttaacgaagaattgattaatttgcacagaggtcaaggtttggatatctattggagagacttcttaccagaaattatacctacccaagaaatgtacttgaacatggtaatgaataagactggtggtttgtttagattgaccttgagattaatggaagctttgtctccatcttcacatcacggtcattcattggttcctttcataaacttgttgggtatcatctatcaaatcagagatgactacttgaatttgaaggatttccaaatgtccagtgaaaagggtttcgcagaagacataactgagggtaaattgtcattcccaatcgtccatgccttaaacttcacaaaaaccaagggtcaaaccgaacaacacaatgaaatcttaagaattttgttattgagaacttctgataaggacataaagttgaagttgatccaaatcttggaattcgataccaactcattggcttacactaagaacttcatcaaccaattggttaacatgattaagaatgataacgaaaataagtacttgccagatttggcctcccatagtgacactgctacaaatttgcacgatgaattgttgtacatcatcgaccatttgtccgaattgaaattatctggtggtggtggttctggtggtggtggttctggtggtggtggtagtgcagaagcctggtacaacttgggtaacgcttactacaagcagggtgactaccaaaaggctatcgaatactaccaaaaggcattggaattagacccaaataacgctgaagcatggtacaacttaggcaacgcatattataaacagggtgactatcaaaaggccatagaatactaccaaaaggctttggaattggaccctaataacgccgaagcttggtacaacttgggtaatgcttattacaagcagggtgactatcaaaaagcaattgaagactaccaaaaagccttggaattagatccaaataacttgcaagcagaagcctggaagaacttaggcaacgcatactataaacagggtgactaccaaaaagccattgaatattatcaaaaagctttggaattagaccctaataacgcttctgcttggtataacttaggcaatgcctattataagcagggtgactatcagaaagctattgaatattatcaaaaggccttggaattggacccaaataacgccaaggcttggtacagacgtggtaacgcatactacaaacagggtgactatcagaaggctatcgaagattatcaaaaagcattagaattagatcctaataacagatctagatcagctggtggtggtggttctggtggtggtggttctggtggtggtggtgcttctttgtgtactatgaaaaagggtccatctggttacggttttaatttgcattctgataagtcaaagcctggtcaattcataagatcagttgatccagactcccctgcagaagccagtggtttgagagctcaagatagaattgtcgaagtaaatggtgtctgcatggaaggtaaacaacacggtgacgttgtttctgctattagagctggtggtgacgaaactaagttattggtagttgacagagaaggttccgccggtagtgctgcaggttctggtgaatttggttcagctgaagccgctgcaaaagaagccgctgcaaaggccggttctgctggttcagccgctggttctggtgaattcggttcttcatccggtgctataatctatacagttgaattgaagagatacggtggtccattaggtattactatatctggtacagaagaaccattcgatcctatcatcatcagttctttgactaagggtggtttagctgaaagaacaggtgcaatccatattggtgacagaatattggctatcaattcatccagtttgaaaggtaaaccattgtcagaagctatccacttattgcaaatggcaggtgaaaccgttactttgaaaatcaaaaagcaaacagatgcacaacctgcctcttcaggttctggt

SEQ ID NO: 205 - DNA, 18864 bp, Artificial Sequence
  gene cassette
atgaatcatttgagagccgaaggaccagcttctgtcttagcaataggtactgccaatccagagaacatcttgttacaagatgaatttcctgactattacttcagagttaccaaatccgagcatatgacgcagttgaaggaaaagtttagaaagatctgtgataagagtatgatcagaaagaggaactgcttcttaaacgaagagcatttgaagcaaaatcctagattagtggaacacgagatgcaaacattggatgctaggcaggacatgttagttgtcgaagttcctaaattgggtaaagatgcatgtgccaaagctattaaggaatggggtcaacccaagtctaagataactcatttgatttttacaagtgctagcactacagatatgcctggtgcagactatcactgtgccaaactacttggtttatcgccctctgtgaagagagttatgatgtatcaactaggttgctacggtggtggtactgtacttagaatcgctaaagacattgcagaaaataacaagggtgccagggtcttggctgtatgttgcgatattatggcttgcttgtttagaggtccatcagaatccgatttggagctgttggttggtcaagctattttcggtgacggtgctgcagctgttattgttggtgcagaacctgatgagtcagtcggtgaaagaccaatctttgaattggtttctaccggtcaaacgattttaccaaatagtgaaggtacaataggtggtcatatcagagaagctggtttgatattcgatttgcacaaagacgttcctatgctaatatctaacaacatcgaaaagtgtctgatcgaggcttttacccccatcggtatttccgattggaatagtatattctggatcacgcatccaggtggtaaagcaatcctggataaggttgaagagaagctgcatttgaagtctgataagtttgtcgacagcagacatgtattgtcggaacacggtaacatgtcttcatccacagtgctgttcgttatggatgaacttagaaagagatctttggaagagggtaaaagcaccacgggtgacggttttgaatggggtgttctttttggattcggccccggtttgaccgtcgaaagagtagttgttagatctgtaccaattaaatacaagttgtctggtggtggtggttctggtggtggtggttctggtggtggtggtagtgcagaagcctggtacaatttgggtaacgcttactacaagcagggtgactaccagaaggctatcgagtattaccaaaaagcacttgaactggatccaaataacgctgaggcatggtataatttgggcaacgcatattacaaacagggtgactatcaaaaggccatagaatactaccaaaaggctttggagctggatcctaataacgccgaagcttggtacaatttgggaaatgcctattataagcagggtgactatcagaaggcaatagaggactaccaaaaagccctagaacttgatccaaataatttgcaggcagaagcctggaagaatttgggtaatgcttactataaacagggtgactatcagaaagctattgaatactaccaaaaagcactggaattggatcctaataacgcttctgcttggtacaatttgggcaacgcttactacaaacagggtgactaccaaaaagctatcgaatattatcaaaaggctctggaactagatccaaataacgccaaggcttggtatagaaggggaaatgcttattataaacagggtgactaccagaaagcaattgaagactaccaaaaagcccttgaactggatcctaataacagatctagaagcgctggtggtggtggttctggtggtggtggttctggtggtggtggtgcttctggtaacaacttagaaacatacgagtggtacaataagtctatttctagagataaggccgaaaagttactacttgacaccggtaaagaaggtgcttttatggttagagattctagaactccaggtacttatacagtctctgtattcacaaaggctatcatctcagaaaacccatgtatcaagcattaccacatcaaggaaaccaacgactctcctaaaagatattacgtggcagaaaagtacgtttttgattcaatcccactgttgattcaatatcatcagtacaatggtggtggtttggtgactagattgaggtatcctgtttgcggtggtagcgcaggttcggctgcaggatcaggcgaatttggttccgccgaggccgctgcaaaagaagccgctgcaaaggctggatctgcaggctcagccgctggttctggagaatttggttctggttctcatccctggtttttcggtaaaattccaagagcaaaggccgaagaaatgttgtctaaacaaagacacgacggtgcatttttgataagggaaagtgagagcgcacctggtgacttttcgttgtctgttaaattcggtaatgatgtccaacatttcaaggtattgagagatggtgctggtaaatactttttgtgggtcgtaaagttcaattccttgaacgaattagtggattaccatagatcaacttccgttagtaggaaccaacagattttcttgagagatatcgaacaagttccacaacagcctacaggttctggagctactaacttctctttgttgaagcaagcaggtgacgttgaagaaaatccaggtccaatggctgtaaagcatttgatcgtgttgaaattcaaggatgaaatcacagaggcacaaaaggaagagtttttcaagacctacgttaatttggtcaacataatcccagctatgaaagatgtatactggggtaaagacgtgacccaaaagaataaggaagagggttatacccatatagtagaagtgacgttcgaatcagttgaaactatccaagattacatcatacaccctgctcatgttggctttggtgacgtctacagatccttctgggaaaagttgctgatcttcgattacactccaagaaagaaattgtctggtggtggtggttctggtggtggtggttctggtggtggtggtagtgcagaagcctggtataatttgggaaacgcttattacaaacagggtgactaccaaaaggccatcgagtattaccaaaaagctcttgaactggacccaaataacgctgaggcatggtataatttgggtaacgcatactataagcaaggtgactaccaaaaggcaattgaatattaccaaaaggccttggagttagaccctaataacgccgaagcttggtacaatttgggtaatgcctactataaacagggtgactatcaaaaggctatagaggactaccagaaagcactagaacttgatcccaataacttgcaagcagaagcctggaagaatttgggtaatgcctattataagcaaggtgactatcaaaaagctattgaatactaccaaaaagctctggaattggaccctaataacgcttctgcttggtataatttgggtaatgcatactacaagcaaggtgactaccagaaggcaatagagtattaccaaaaagccttagaactagacccaaataacgccaaggcttggtacagaaggggtaatgcctactacaagcagggtgactaccaaaaagctattgaggactaccaaaaagcacttgaactggatcctaataacagatctagatcagctggtggtggtggttctggtggtggtggttctggtggtggtggtgcttccggtcaagatagaagtgaagccacattgattaaaagattcaaaggagaaggtgttagatacaaggctaagctgatcggtatcgatgaagtttctgctgctagaggtgacaaattgtgtcaagactctatgatgaagctgaagggcgttgtcgcaggtgccagatctaagggtgaacataagcaaaagatatttttgacgatctcattcggtggtattaaaatcttcgatgaaaagactggtgctttacaacatcaccatgcagtacacgaaatctcttacatcgctaaggatatcacagaccatagagcattcggttacgtttgcggtaaagaaggcaatcatagatttgtcgctattaaaaccgcccaagccgctgaaccagtcatcttggatttgagagacttattccagctaatctatgaactaaagcaaagagaagaattggaaaagaaagctggtagcgcaggatcggcagccggtagcggagaatttggttctgctgaggctgcagccaaagaagctgcagccaaggccggctctgctggttcagctgcaggctctggtgaatttggttctggttctcatatgggttctcaattttgggtaacttctcaaaagactgaagcttccgagagatgtggtttgcaaggctcctatattttaagggtggaagccgagaagcttaccctacttacgctgggtgcacagagtcaaatattggaacccctgttgttctggccatatactttattgagaagatacggtagagataaagttatgttcagtttcgaagctggtagaagatgcccaagcggtcctggaacttttacattccagacatcacaaggcaatgatatctttcaggcagttgaagccgctattcaacagcaaaaagcccagggtaaagtcggacaggctcaagacattctaagattggaacaccatcaccatcatcatggttctggtgctactaacttctctttgttgaagcaagcaggtgacgttgaagaaaatccaggtccaatgggtttgtcttcagtttgtacattctctttccaaacgaactaccatactttgctgaaccctcacaacaacaatcccaaaacttctttgctttgctacagacatccaaaaacccctattaagtatagctacaacaatttcccatcgaaacattgtagtactaagagcttccatttgcaaaataagtgctccgaatctttgtctatcgctaagaactcaattagagctgcaactacaaatcagacggaaccacctgagtcggataatcactctgtagccaccaaaattttgaactttggtaaagcttgttggaagctgcaaagaccatacacaataatagccttcacctcctgtgcttgcggtttgtttggtaaagaactgttgcataacacaaatttgatttcgtggtctttgatgttcaaggcatttttctttttggttgcaatcctttgcatcgcctcttttaccacgactattaatcaaatctatgatttgcacatcgacagaattaataagcccgatttgccactagcttcaggtgaaatctccgttaatactgcatggattatgtcaatcattgtcgccttgttcggtttaatcatcacaattaaaatgaaaggtggtccattgtacatcttcggctactgtttcggtatattcggtggtatagtatattccgttccaccttttagatggaaacaaaaccccagtaccgctttcttactaaatttcttggcacatatcatcacaaacttcaccttctactacgcttctagagctgctttgggtttgccattcgaattaagaccatcttttacatttttgctggcttttatgaaatcgatgggttctgcattggccttgattaaagatgcatctgacgttgaaggtgacacaaaattcggcatcagtaccttggctagcaagtacggttctagaaatttgactttgttttgttcaggtatcgtattgttatcctacgtggcagccattttagccggtatcatttggccacaagcttttaacagtaatgtcatgctacttagccacgcaatattggccttctggctgatcttgcagacgagagattttgctttaactaattatgaccctgaggcaggtagaagattctacgaattcatgtggaagctgtactacgctgaatatttggtttacgtctttattaagttgtctggtggtggtggttctggtggtggtggttctggtggtggtggtagtgctgaagcatggtacaacttaggcaacgcatactacaagcagggtgactaccagaaggcaattgagtattaccaaaaagccttagaactagacccaaacaatgccgaggcttggtataacttgggcaatgcttattacaaacagggtgactatcaaaaggctatagaatattaccaaaaggcacttgagctggaccctaacaatgcagaagcctggtataacttaggcaatgcttattacaagcagggtgactatcagaaggccatcgaggactaccaaaaggctttggaactggatccaaacaatttgcaggctgaagcatggaagaatttgggtaacgcttactataaacagggtgactatcagaaagcaatagaatactaccaaaaagccctagaacttgaccctaacaatgcctctgcttggtacaacttgggtaatgcttactataagcagggtgactaccaaaaagctatcgaatattaccaaaaagcactggaattggacccaaacaatgcaaaggcctggtatagaagaggtaacgcctactacaaacagggtgactaccaaaaggctattgaagattaccaaaaggctctggaactagatcctaacaacagatctagatccgctggtggtggtggttctggtggtggtggttctggtggtggtggtgcttctgcagaatacgttagagctctgttcgatttcaacggtaacgatgaagaggacttgccttttaagaaaggtgacattttgagaatcagggacaaaccagaagagcaatggtggaatgctgaagattctgagggtaaaagaggaatgattcctgttccctatgtcgaaaagtacggctcagcaggttccgctgcaggatctggcgaattcggttcagccgaggccgctgcaaaagaagccgctgcaaaggctggaagtgcaggcagcgccgctggttccggagaatttggtagtttgattaaacatatgagagccgaagctttattcgattttactggtaactccaaacttgaactgaatttcaaggcaggtgacgttattttcttgttgagtagaattaataaggactggttggaaggtactgttagaggtgctactggaatattcccactttcttttgtgaaaatcctgaagggctcaggtgctactaacttctctttgttgaagcaagcaggtgacgttgaagaaaatccaggtccaatgaaatgtagcactttttctttctggttcgtttgcaagatcattttctttttcttttcttttaatatccaaacttcgatcgcaaatccaagagaaaacttcttaaagtgtttctcacaatacattcctaataacgccacgaatttgaagctggtatacactcagaacaacccactgtacatgagcgtgctaaactcgacaatccataatttgagattcacttccgatactacacccaaaccattagtaatcgtgacaccttctcatgtttcacacattcaaggaaccatactatgctctaagaaagtcggtttgcagattagaacaaggtctggtggtcatgatagtgaaggcatgtcctacatcagtcaagttccattcgttatcgtcgatttgagaaacatgaggtctatcaaaatagacgttcactcacagacggcttgggtcgaggcaggtgccactttgggagaagtttactactgggtcaacgaaaagaatgaaaatttgtctcttgctgcaggttactgtccaactgtctgcgctggtggtcattttggtggtggtggttatggacctcttatgagaaactacggtttggccgctgataatatcattgacgcacatttggtaaatgtgcacggtaaagttctagatagaaagtcaatgggtgaagatttgttttgggcattgagaggtggtggtgctgaatcctttggtataatcgtagcttggaaaattagattggttgcagtcccaaagtctacaatgttctcagttaagaaaattatggaaatccatgagctggtaaagttggtgaataagtggcaaaacatcgcttacaagtacgataaggacttgctgctaatgacccatttcatcacgagaaacatcactgataaccagggtaaaaataagacagcaatacacacctacttctcttcagttttcttgggtggtgttgattccttagtggatttgatgaataagagtttccctgaactgggtattaagaaaactgattgtagacaattgagctggatcgacacaatcatattctatagtggtgttgtcaactacgatactgacaacttcaacaaagaaatccttctggatagaagtgccggacaaaatggcgctttcaaaattaagttggactacgttaaaaagcctatacccgagtcagtatttgtgcagatccttgaaaaactgtatgaagaggatattggtgctggaatgtacgcattatatccatacggtggtataatggatgaaatctccgagagtgccataccattccctcatagagctggtatcttgtacgaactgtggtacatatgttcttgggaaaaacaagaggataacgaaaagcacttaaactggatcaggaacatctataacttcatgactccttacgtttctaaaaaccccagattggcttatttgaattacagagatttggacataggtatcaacgatcctaaaaatccaaacaactacacacaagcaagaatttggggtgaaaagtacttcggtaaaaatttcgatagattggttaaagtcaagaccttagttgaccccaacaactttttcagaaacgaacaatctattccacctttgcctagacataggcacggctctggtgctactaacttctctttgttgaagcaagcaggtgacgttgaagaaaatccaggtccaatgaactgtagcactttttctttttggttcgtttgcaagataatatttttctttttgtcctttaatatccaaatcagtatcgccaacccacaggaaaactttttaaagtgtttctctgagtacatccccaacaacccagctaaccctaagtttatatatacacaacatgatcagctgtacatgagcgtattgaactcgaccattcaaaatttgagattcacttctgacactacacctaagcccttggtcatagtaactccttctaatgtctcacatatacaagcttctatcttgtgctctaagaaagttggtttgcagattagaacaaggtctggtggtcacgatgcagaaggtttatcctatattagtcaagtcccatttgccatagtagatttgagaaatatgcatactgtgaaagttgacatacactcacagactgcttgggtggaagcaggtgccacattgggagaggtttactactggatcaacgagatgaacgaaaactttagtttcccaggtggttactgtcccacagtcggtgttggtggtcatttttctggtggtggttatggagctttaatgagaaactacggtttggctgcagataatatcattgacgcacatttggtgaacgttgatggtaaagttcttgacagaaaatcaatgggtgaagatttgttttgggctatcagaggtggtggtggtgaaaatttcggtataatcgccgcttgcaaaattaagttggttgtcgtacctagcaaagctactattttctctgtcaaaaagaacatggaaatccatggtttagtaaagttgtttaataagtggcaaaacatcgcatacaagtacgataaggatttgatgcttaccacgcatttcagaactaggaacatcacagataaccatggtaaaaataagactacagttcacggatacttctcttcaattttcttgggtggtgttgattctcttgttgatttgatgaataagtcattcccagaactgggtattaaaaagacagattgtaaggaactgagctggatcgacaccacgattttctatagtggtgtggttaattacaacaccgccaacttcaaaaaggaaatcttgctggatagatccgctggtaaaaagaccgctttttctattaaacttgactacgttaagaaactgatccctgaaactgcaatggttaagatattggagaagctgtacgaagaggaagtcggcgtaggcatgtacgttttgtatccatacggtggtataatggatgagatctccgaaagtgccataccatttcctcatagagctggtatcatgtatgaattatggtacaccgctacgtgggagaagcaagaagataacgagaaacacataaactgggtcagatctgtatacaacttcactacaccttacgtttctcagaacccaagattggcatatttgaactacagagatttggacttgggtaaaaccaaccccgaatctccaaataactatacgcaagcaagaatttggggtgaaaagtacttcggtaaaaatttcaacagattggtgaaggttaagacaaaagccgatccaaacaacttctttagaaacgaacaatctattccaccattgccaccaagacatcatggttccggcgctactaacttctctttgttgaagcaagcaggtgacgttgaagaaaatccaggtccaatgtcagaagagtccttatttgaatcttcaccacaaaagatggagtacgaaatcactaactactctgagagacatacagaattgcctggacacttcatcggtttgaacacagttgacaagctggaagagtctccattgagagatttcgtcaagtcccatggtggtcacaccgtaattagtaagatcttgatagctaacaacggtatcgctgcagtcaaggaaattagatctgttagaaagtgggcatatgaaacctttggtgacgatagaacggtccaattcgtagctatggcaactcctgaagacttggaggccaatgctgaatatatcagaatggccgatcaatacattgaagttccaggtggtacaaataacaataactacgctaatgtcgacttaatagtagatatcgctgaaagagcagacgtggatgccgtttgggctggttggggacatgcttccgaaaaccctttgttacccgaaaaattgtctcagagtaagagaaaagttatttttattggtccacctggaaatgcaatgagatcattaggtgacaagatatccagtactatcgtggcacaatcagccaaagttccatgtattccttggtccggcaccggtgttgacacggtgcatgttgatgaaaagactggtttggtttctgtagatgacgatatctatcagaagggatgttgcacttcacctgaagatggtttgcaaaaggctaagagaatcggtttcccagttatgatcaaggcatcagaaggtggtggtggtaaaggtatcaggcaggtcgaaagagaagaggatttcatcgctctgtaccatcaagccgctaatgaaatacccggttctccaattttcataatgaaactagctggaagggcaagacatttggaagttcagctacttgctgaccaatacggcactaatatttccttgttcggtagagattgcagtgttcaaagaagacatcaaaagattatcgaagaggcaccagtcactatagcaaaagccgaaacatttcacgagatggaaaaggcagctgttagattgggtaaattggtcggatatgtaagtgctggaacagtcgaatatttgtacagccatgacgatggtaaattctactttttggaacttaacccaagattacaagttgagcaccctactacagaaatggtttctggtgttaatttgccagctgcacaactgcagattgctatgggtatccctatgcatagaatcagtgatatcaggactctgtacggtatgaatccacacagcgcttcggagattgacttcgaattcaaaactcaggatgcaactaagaaacaaagaagaccaatcccaaagggtcattgtaccgcttgcagaattacgtccgaagaccccaatgatggttttaaaccatctggtggtactttgcacgaactaaactttagaagctcgtctaatgtctggggttatttctcagtaggcaacaacggtaacatccattctttttcagattcccagttcggtcacatcttcgcatttggagaaaataggcaagcctctagaaagcatatggttgtcgctcttaaagaactgtcaatcagaggtgacttcagaaccacggttgaatacttaattaaactgttggaaactgaagacttcgaagataatacgattactacaggttggttggacgatttgataacccataagatgacggcagaaaaacctgatcccaccttggccgttatctgtggtgccgctacgaaggcctttttagcttctgaagaggctagacataagtacatagaaagcctgcaaaagggtcaggtactatcgaaagacttactacaaacaatgtttcctgtggatttcatccacgaaggtaaaagatacaagtttactgttgctaagtctggcaacgataggtacacgttgttcattaatggtagcaagtgcgacatcattctaagacaactttcagatggtggtttgctgatcgcaattggtggtaaatcacatactatctattggaaggaagaggtcgcagccacaagattgagtgtagacagcatgaccacgttgttagaggttgaaaacgatccaactcaattaagaacaccatctcctggtaaacttgtgaaatttctggttgaaaatggcgagcatataatcaagggtcaaccctacgctgagattgaagttatgaaaatgcagatgccattggtttctcaagaaaacggtatagttcaactacttaaacagcctggatcaaccatagtagctggtgacatcatggcaattatgacgttagacgatccatccaaggtgaaacatgctcttccttttgagggtatgctgcccgatttcggttctccagttattgaaggcactaaaccagcatacaagtttaaatcgttggtttctacactggaaaacatcctaaagggttacgataaccaagttattatgaatgcttctttgcaacagttgatagaagtcttgagaaatcctaagttaccctattcagaatggaaattgcatattagcgctcttcactccagattgcctgcaaaattggatgaacaaatggaagagctagtcgctagatctttgagaagaggtgctgtatttccagcaaggcaattgagtaagctaattgacatggcagttaaaaacccagaatacaaccctgataaactgttgggtgccgtagtggaaccattggcagatattgcccataagtactctaatggtttagaagctcatgagcactcaatcttcgtgcatttcttggaagagtactacgaggttgaaaaattgttcaacggtcctaacgtcagagaagagaacatcatcctgaagttgagagatgaaaacccaaaggacttggataaagtcgctcttactgtactgagtcatagcaaggtttctgccaaaaataacttaatcctagctatcctgaagcactaccaacctttgtgtaagctgtcatccaaagtttctgcaatattttcaactccattgcaacatatcgtagagcttgaatctaaggctaccgcaaaagtggctttgcaggcaagagaaattttgatccaaggtgctttgccatcagttaaagaaagaacagagcaaatagaacacatcctgaagagtagcgttgtcaaagtcgcatacggttcgtctaatcctaagagatctgaacccgatttgaatatacttaaggatttgatcgattcaaattacgtagtgtttgacgttttactacagttcttaactcatcaagatcctgttgtcacagctgcagccgctcaagtctatataagaagggcctatagagcttacactatcggtgacattagggtacacgaaggcgtgacagttccaatcgtggaatggaaatttcaattgccctccgcagcctttagtaccttcccaacggtaaagtcaaaaatgggtatgaacagagctgtttctgtttctgatttgagctatgtggctaattcgcaatcatcccctttaagagaaggtattctaatggctgtggaccatttggacgatgttgatgaaattttgtctcaatctttggaagttattccaagacaccaaagtagctcgaatggtcccgctccagataggtctggatcttcagcaagtttaagcaacgtagccaatgtgtgtgttgcttccactgagggttttgaaagtgaagaggaaatcttggttagattgagagaaattttggatttgaacaaacaagaattgattaatgcttccatcagaaggatcacattcatgttcggttttaaagatggtagttaccctaagtactacacctttaatggtcccaactacaacgagaacgaaactatcagacatatcgaacctgccttagctttccaattggaactgggtagattgtcaaacttcaacatcaagccaattttcactgataacagaaacatccatgtgtacgaagctgtttcaaagacatccccattagataagagatttttcaccagaggcatcattaggacgggtcacattagagatgatattagcatacaagagtacttgacttcggaagctaacagattaatgtctgacatcctagataatttggaagttaccgacacgtcgaactctgatttgaaccatatctttattaacttcatcgcagtgttcgacatatctcctgaggatgttgaagctgcatttggtggtttcttggaaagattcggtaaaagattgctgagattgagagtctccagtgctgaaatcagaatcatcattaaggatccacaaactggtgcccctgtacccctgagagctttgatcaataatgtttctggttacgtaattaaaaccgagatgtacacggaagtcaagaatgctaagggtgaatgggtattcaagagcttgggtaaacccggctcgatgcacttaagaccaattgcaacaccatatcctgtcaaagaatggttgcaacctaagagatacaaagcccacttaatgggtactacatacgtttacgatttcccagaattgttcagacaggcttcttcttctcaatggaagaatttttccgccgacgttaagctgactgacgatttctttatcagtaacgaactaatcgaggatgaaaatggtgaacttacagaggttgaaagagagccaggagcaaatgccattggcatggtcgcttttaagatcactgtaaagacaccagaatatcctaggggtagacaattcgtagtggttgcaaacgacatcacctttaaaattggttctttcggacctcaagaagatgagtttttcaataaggttactgaatacgctaggaaaagaggtataccaagaatctacttggccgctaattctggagcaaggattggcatggccgaggaaatagtgcctttatttcaggttgcatggaacgacgcagccaacccagataagggattccaatatttgtatttgacttctgagggtatggaaacattgaaaaagttcgataaggaaaactcagtgctgaccgagagaactgttattaatggagaggaaaggttcgtaatcaaaactataatcggttctgaagatggtttgggcgtggagtgtctgagaggtagcggtttgattgctggtgcaacttctagagcttaccatgatatttttactatcacactggtcacttgcagatctgtaggcataggtgcttatttggttagattgggtcaaagggccatccaggtcgaaggccaacctattatattgactggtgcccccgctataaacaaaatgctgggtagagaagtttatacctccaatttgcagttgggtggtacgcaaatcatgtacaataacggtgtttctcatttgacagctgtagacgatttggctggtgtggaaaagattgttgaatggatgtcatatgtgccagctaaaagaaacatgcccgttccaatattggaaactaaggacacatgggatagaccagtagattttacccctacgaatgacgaaacctatgatgtgagatggatgattgagggtagggaaactgagtctggttttgaatacggtttgttcgataagggttctttctttgaaacattatcaggctgggccaagggtgtcgtagtgggaagagctagattgggtggtattcctctaggtgttattggtgtagaaactagaacagttgaaaatttgatccccgcagatccagccaaccctaattctgctgaaactttaattcaggaacctggtcaagtttggcatcccaactcagcttttaaaaccgcacaggccattaatgatttcaacaacggtgaacaattgccaatgatgatactggctaactggagaggtttttctggtggtcaaagggatatgttcaacgaagttttgaagtacggtagttttatcgtcgacgcactggtagattacaagcaacctatcataatatacattccaccaactggtgaattaagaggtggttcttgggttgtcgtagacccaaccattaacgcagatcagatggaaatgtacgccgatgtgaatgctagagcaggtgttttggaaccacaaggaatggttggtattaagtttagaagagaaaaattgctggatactatgaacagattagacgataagtacagggaattgagatctcaactgagcaataagtctttggctccagaagttcatcaacagatctctaagcaactggctgatagggaaagagaattgttgccaatatacggtcagatctcattgcaatttgccgacttacacgataggtcatccagaatggtggctaagggtgttatttcaaaagaattagagtggacagaagctagaagatttttcttttggagattgagaagaagattgaacgaggaatatttgattaaaagattgtcacatcaagttggcgaggcttctagattggaaaagatcgcaaggattagatcttggtatccagcatcagtcgatcacgaagacgatagacaagtagccacttggattgaggaaaattacaagacactggacgataagttgaagggtttaaagctagaatcctttgcccaagacttggctaaaaagattagaagtgaccatgataatgctatcgatggtttgagtgaagttattaaaatgcttagcactgacgataaggaaaaactgttgaagacattgaagaaactgtctggtggtggtggttctggtggtggtggttctggtggtggtggtagtgccgaagcttggtataacttgggaaatgcttattacaagcagggtgactaccaaaaggccatagaatactaccaaaaggctcttgagctggatcctaataacgcagaagcctggtataacttaggcaatgcatactataaacaaggtgactaccaaaaggcaatagagtactaccaaaaggccttggaattagatccaaataacgctgaggcatggtataacttgggcaacgcctactataaacagggtgactatcaaaaggctatagaagattaccagaaggcactagagcttgatcctaataacttgcaagccgaagcttggaagaacttaggaaatgcatactataagcaaggtgactatcaaaaagctattgaatattaccaaaaggctctggagttggatccaaataacgcatctgcttggtacaacttaggcaacgcctactataagcagggtgactatcaaaaagcaattgaatattatcaaaaggccttagagctagatcctaataacgctaaagcatggtataggagaggcaatgcatactacaaacagggtgactaccaaaaagctatagaagattaccaaaaggcacttgaactggatccaaataacagatctagatccgctggtggtggtggttctggtggtggtggttctggtggtggtggtgcttctggttctcatatgagattgggagcccaatctattcagccaaccgctaacttagatagaacggacgatttggtctatttgaatgtaatggaattggttagagctgttttggagttgaaaaatgaactagcacaattgccaccagaaggttacgtggttgtcgtaaagaatgttggtttgactcttagaaagttgataggctcggtcgacgatttgctaccatctttgccatcttcttctagaactgaaatagagggtacacaaaagcttctgaacaaagatttggctgaattgattaataagatgagattggcacaacagaacgccgttacttctttgtctgaggagtgtaagagacaaatgctaactgcttctcatactttggctgttgatgcaaagaacttgttagacgctgtggatcaagcaaaagttttagccaatttggctcacccacctgccgaaggttctgctggatcagctgcaggatccggcgaatttggttctgctgaagccgctgcaaaagaggctgctgcaaaagctggatctgcaggtagtgctgctggtagcggagaatttggttctggtgccatggctactcctggttcagaaaacgttctaccaagagaaccattgattgcaacagccgtgaagttcttgcagaactctagagttagacaatctccattggcaactagaagagcatttttgaaaaagaaaggtttgaccgacgaggaaattgatatggctttccaacagtccggtactgcagccgatgaaccatcttcattgtggggaagtggc

SEQ ID NO: 206 - DNA, 19473 bp, Artificial Sequence
  gene cassette
atgggttctgctggttcagctgcaggttctggtgaattcggttccgctggtagtgccgctggttctggtgaatttggttctgctggttcagcagccggttctggtgaattctcctattaccatcaccatcaccatcacttggaatctacttcattatacaaaaaggctggttccggtagtgccagaaacgcttacttgagaaagaaaattgctagattgaagaaagataatttgcaattggaaagagatgaacaaaacttggaaaagattatcgctaatttgagagatgaaatagcaagattggaaaatgaagttgcttctcatgaacaaggttccgcaggtagtgccgccggttctggtgaatttgctgaagccgctgcaaaggaagccgctgcaaaagcaggttctgccggttcagccgctggtagtggtgaattttcttactatcaccatcaccatcatcacttggaatctacctcattatataaaaaggccggttccggtagtaacttggttgctcaattagaaaatgaagtcgcatcattggaaaacgaaaacgaaactttgaaaaagaaaaacttacataagaaagatttgatcgcttacttagaaaaggaaatagcaaatttgagaaagaaaatagaagaaggttccgctggtagtgcagccggtagtggtgaattcggttctgctgaagctgcagccaaggaagctgcagccaaagaagccgctgctaaagaagctgcagccaaagctggttctgcaggttctgccgcaggttccggtgaatttggttcttcatactatcaccatcaccaccaccacttggaatctacctcattatacaagaaagctggttccggtagtcaaaaggtcgctgaattgaaaaacagagtagctgttaagttgaacagaaacgaacaattgaaaaataaggtagaagaattgaaaaatagaaacgcttacttgaaaaacgaattggcaactttggaaaacgaagtagctagattagaaaacgatgttgctgaaggttctgctggttctgctgctggttctggtgaattcgctgaagcagccgctaaggaagcagccgctaaagccggttccgccggttctgctgcgggctctggtgaattttcctactatcaccatcatcatcaccacttggaatctacatcattatataagaaagccggttccggtagtaatgaagttactacattggaaaacgatgctgcttttattgaaaacgaaaacgcatacttagaaaaggaaatcgctagattgagaaaggaaaaggccgctttgagaaatagattagctcataagaaaggttctgctggtagcgctgctggctctggtgaatttggttccgccgaagccgctgctaaggaagccgctgccaaagaagccgctgccaaggaagccgctgctaaggctggttccgccggttcagctgcaggctctggtgaattcggttctagaccacctaccatctctaatccacctccattgatttccagtgctaaacatccatccgtcggtagtgcaggttccgctgccggctctggcgaatttgccgaagctgctgccaaagaagcagccgctaaagctggttcagcaggttccgctgccggatctggcgaattcaatttcttgcaatctagaccagaacctactgctcctccagaagaaagtttcagatctggtggttcagctggttccgccgcaggatctggcgaatttggttccgcagaagctgccgctaaagaagctgctgcaaaagaagcagccgccaaagaagctgctgcaaaagccggtagtgctggttcagctgccggttccggtgaattcggttcttcaaaaggtaccggtttaaatccaaacgctaaagtttggcaagaaattgctcctggtaacggttctgcaggttccgcagctggttccggtgaattcgccgaggccgctgctaaggaagcagcagccaaagcaggtagtgctggttccgcagctggttcaggtgaattcccagacggtggtaccactttcgaacatttgtggtccagtttagaacctgattctacatacggttctgccggttctgcagcaggcagcggtgaattcggttctgccgaagctgctgctaaagaagctgctgccaaggaagctgctgctaaggaagctgctgccaaagccggtagtgcaggttctgctgccggttcaggtgaatttggttcttcttactatcaccaccaccaccatcacttggaatctacatcattatacaagaaagccggttctggtagtaagagaatcgcatacttaagaaagaaaatcgctgcattgaagaaagataacgcaaacttagaaaaggacatcgctaacttggaaaacgaaatcgaaagattgattaaagaaatcaaaaccttggaaaatgaagttgcatctcatgaacaaggttcagccggttctgcagcgggctccggtgaatttgccgaagctgcagcaaaagaagctgccgctaaggctggtagtgctggttctgctgcaggcagcggtgaattttcttactaccaccatcaccaccatcacttggaatctacttcattatataagaaagcaggttctggtagtaacttgttagcaacattaagatctaccgctgcagtcttggaaaacgaaaaccatgtattggaaaaagaaaaggaaaaattgagaaaggaaaaagaacaattgttgaataagttggaagcttacaaaggttcagcaggttctgcagcgggctctggcgaattcggttccgccgaagctgcagcaaaggaagctgcagctaaagaggccgctgcaaaagaagctgctgccaaagcaggtagtgcaggttccgcagccggctccggcgaatttggttcaccagctacatcccaacatcctccacctccacctggtcatagatctcaagctccttcacatggttccgcaggtagtgcagctggatctggcgaattcgccgaagctgccgctaaggaagctgctgcaaaagctggttccgctggttcagcagcaggttccggtgaattcgaattgaattctttgttgatattgttagaagcagccgaatatttggaaagaagagatagaggttctgccggtagtgctgcaggtagcggcgaatttggttctgcagaagcagccgccaaggaagcagctgcaaaagaagcagcagctaaagaagcagctgcaaaagccggttctgctggttcagccgcaggatctggagaattcggttccagaccacctacaatttccaatccacctccattgatctcttctgccaagcatccatccgttggtagtgcaggttcagctgccggtagtggtgaatttgccgaagccgccgctaaggaagccgccgccaaagcaggttcagccggttccgccgcaggttcaggtgaattcaatttcttgcagtcaagaccagaacctaccgctcctccagaggagagtttcagatctggtggtagtgccggttcagctgccggctctggagaatttggttctgcagaggctgctgccaaggaagccgcagctaaagaagccgctgcgaaagaagccgccgctaaagctggtagtgcaggtagtgctgcgggatctggcgaattcggttcttctaagggtactggtttgaaccctaatgccaaggtctggcaagaaatcgcccctggtaacggttccgcaggttccgccgcaggtagtggtgaattcgccgaggctgccgccaaggaagccgccgctaaggcaggtagtgctggttcagcggccggctctggtgaatttccagacggtggtacaacctttgagcatttgtggtccagtttagaacctgattctacgtacggttctgctggttccgctgcaggatctggcgaattcggttccgcggaagccgccgcaaaagaagccgccgccaaagaagccgccgcaaaggaagccgcagcaaaggcaggtagtgccggctccgccgctggcagtggcgaatttggttcttcatattatcaccatcatcatcatcacttggaatctacttcattatacaagaaagcaggttccggttctaaaagaattgcttacttaagaaagaaaatcgcggctttgaagaaagacaatgctaacttagaaaaagatattgccaacttggaaaatgaaatcgaaagattaattaaggaaattaaaacattggaaaacgaagttgcatcacatgaacaaggttcagctggttccgctgcagggtccggcgaatttgcagaagccgccgccaaggaagccgcagccaaagctggtagtgcaggttctgccgctggctctggcgaattttcttactatcatcatcaccatcaccacttggaatctacttcattatacaagaaagcgggttcaggttctaacttgttagcaactttaagatctacagccgctgttttagaaaatgaaaaccatgtcttagaaaaagaaaaggaaaagttgagaaaggaaaaggaacaattattaaataagttagaagcctacaagggttcagcaggttccgcagcaggctcaggcgaatttggttctgcagaagcggctgctaaggaagctgccgcaaaggaagcagctgctaaggaggccgctgcaaaggctggttctgctggttccgccgcgggctctggagaattcggttccgctttggttgatgacgccgctgattatgaacctccaccttcaaataacgaagaagctttaggttccgctggttccgctgcaggttccggcgagttcgcagaagccgcagcaaaagaagccgcagctaaggcaggtagtgccggatccgccgctggcagtggagaattcagagaattgttcgatgacccatcttacgtcaacgtacaaaatttggataaagctagacaaggttccgccggttctgcagcgggatctggggaatttggttctgcagaagctgccgccaaagaagctgcagctaaagaagccgcagccaaagaagctgctgctaaggccggttctgctggttctgccgcaggatctggggaattcggttccaagaatactaagagtatgaacttcgataacccagtttacagaaagactacagaagaagaaggttcagccggttcagccgccggttccggtgaatttgcagaggctgccgctaaagaggctgccgctaaggccggtagtgctggttctgcagccggctccggagaattcagatctttgccatccacatggattgaaaacaaattatacggcatgtcagaccctaattggggttctgcaggttcagctgcgggatctggtgaattcggttcagcagaagccgcagccaaggaagccgctgcaaaggaggccgctgccaaagaagcagctgctaaggctggttcagccggttccgcagccggcagtggtgaatttggtagtgttgtcgataattctccacctccagctttgcctccaaagaaaagacaatctgctccatctggttcagcaggttcagccgctggttcaggtgaatttgccgaagcagctgccaaggaagctgccgccaaggcgggcagtgcaggttcggctgcggggtctggtgaattcactcaaagatctaaaccacaacctgcagttcctccaagaccatctgctgacttgattttaggttccgccggttccgcagctggctctggcgaattcggttccgctgaggctgccgctaaagaagcggccgctaaagaggcagccgctaaagaggcggccgctaaagcaggttctgcaggttcagcagcaggtagtggtgaatttggttctacagatgaagaaagagaagaaaccgaagaagaagtttatttgttgaactctaccactttgggttcagctggttctgctgcgggttctggcgaatttgcagaagcagctgctaaggaagccgcggcaaaggctggttctgcgggctccgccgcaggttctggtgaatttgatggtaatgtatctggtactcaaagattagactcagctaccgttagaacttattcatgcggttctgccggtagtgcagcgggctctggggaattcggttccgcagaagccgctgcaaaagaagccgctgcaaaagaagccgctgcgaaggaggctgctgctaaggcaggttccgccggtagtgctgcgggttccggcgaatttggttccagttactatcaccatcatcaccaccacttggaatccacaagtttatataagaaagctggttctggttcacaaaaggtagctcaattgaaaaatagagttgcatacaagttgaaggaaaacgctaagttggaaaacatagtagcaagattagaaaacgataacgctaatttggaaaaggacatcgcaaatttggaaaaggatatagctaacttggaaagagatgttgctagaggttctgctggtagtgccgcaggctctggcgaattcgctgaagctgccgctaaagaggctgcggctaaagctggttcagctggttctgcagcggggtctggtgaattttcttattatcaccatcatcaccatcacttggaatccaccagtttatacaagaaagccggctctggttcaaacactgttaaggaattgaaaaattacattcaagaattggaagaaagaaacgctgaattgaaaaatttgaaggaacatttgaagtttgcaaaagccgaattggaattcgaattagcagcccataaatttgaaggttctgccggttctgccgccggatctggagaatttggttctgcggaggctgccgctaaagaagccgccgctaaagaggctgcagctaaggaagctgcagcaaaggctggttctgccggttccgctgccggctccggcgaatttggttcacatgatgactccttgccacatcctcaacaagctacagatgactctggtcatgaatccgacggttccgcaggctctgctgccggctccggcgagtttgctgaagccgctgctaaagaggctgctgctaaagccggttctgccggttcagcagctggatctggagaatttggttccccaaatgctggtagtgttgaacaaaccccaaagaaacctggtttgagaagaagaggtagtgctggttctgccgctggctccggagaatttggttcagccgaagctgcggccaaagaggctgctgcaaaggaggctgcggctaaggaagccgccgctaaagccggttcagctggttccgcggcaggctccggggaatttggttcttcttattatcaccaccaccaccatcacttggaatccacaagtttatacaagaaagcaggctctggttcattcgaaaacgtcactcatgaattcattttggcaaccttagaaaacgaaaacgctaagttgagaagattagaagcaaagttggaaagagaattggctagattaagaaatgaagtagcttggttgggttctgcgggctcggccgctggctctggtgaattcgccgaagctgcggccaaggaggctgccgcaaaggccggttctgccggttccgcagcgggatccggcgaattttcttactaccatcatcaccatcaccacttggaatccacaagtttatacaagaaagcgggttctggttcacaaaaagttgaagaattgaaaaataagatagcagaattggaaaacagaaacgctgtaaagaaaaatagagttgcacatttgaagcaagaaatcgcttacttgaaggatgaattagcagcccatgaattcgaaggtagtgccggttccgctgctggctcaggcgaatttggtagtgcagaagctgccgctaaggaggctgccgccaaagaagcagccgcaaaagaagctgccgcaaaagccggttctgcgggctctgctgccggatccggcgaattcggttcagtctccagtactaaattagtatcctttcatgatgacagtgatgaagacttgttacatatcggttctgcaggctcagccgctggctctggagagtttgcagaggcagctgctaaagaagccgccgcaaaggcaggttctgcaggttctgcagctggtagtggtgaattcgctgctgcaaccccaatatctacttttcatgatgactcagacgaagacttgttgcatgtcggttccgcaggttcagcagcgggatccggtgaatttggttcagcagaagctgccgccaaggaggccgctgctaaagaagcagcagccaaggaagcagcagcaaaggccggctctgctggttctgctgccgggtccggcgaatttggttcttcttattaccaccatcatcatcaccacttggaatccacaagtttatataagaaagccggttctggttcacaaaaggtggaatcattaaaacaaaagattgaagaattgaagcaaagaaaagcacaattgaaaaatgatattgccaatttggaaaaggaaatcgcttacgcagaaacaggtagtgccggttcagccgcgggctctggtgaattcgcagaagctgccgcaaaagaagctgcagcaaaagccggttctgcaggctctgctgctggctctggcgaattttcctactatcatcatcatcatcatcacttggaatccacaagtttatacaagaaagcgggtagtgaatttttcagaagagaaagaaacaagatggcagccgctaagtgtagaaacagaagaagagaattgactgatacattacaagctgaaacagatcaattagaagacgaaaaatcagctttgcaaaccgaaatcgcaaatttgttgaaagaaaaagaaaaattggaattcattttagcagcccatagaccagcttgcaaaatacctgatgacttgggttttccagaagaaatgtctttagaaggtagtgccggtagtgccgctggctcaggtgaatttggtagtgcagaagctgccgcgaaagaagccgcagctaaagaagctgccgccaaagaggcagccgcaaaggcaggttcagcaggttcagctgccgggtccggggaatttggttcattccaaatgccagctgacactcctccacctgcatatttgccacctgaagatcctatgacaggtagtgccggttctgctgccgggtctggcgaattcgctgaagccgctgctaaggaggctgcagctaaggccggctctgcaggttccgctgcaggttcaggtgaatttgaaagagaatctaacgaagaaccacctccaccttatgaagatccatactggggtaatggtggttctgccggtagtgccgccggctcaggcgaatttggttctgcggaggctgctgcaaaggaagctgcggccaaggaagctgccgcaaaagaggctgctgccaaggccggttcagcaggttcagcagctgggtccggtgaatttggttccagttattatcaccaccatcatcaccacttggaatctacctcattatataagaaagcgggttccggtagtcaaaaagttgcagaattgaaaaacagagttgctgtcaaattaaatagaaatgagcagttgaaaaataaggtcgaggagttgaaaaatagaaacgcatacttgaaaaatgaattggctactttggaaaacgaagtcgcaagattagaaaatgatgtagctgaaggctctgctggttccgcagcgggctcaggtgaattcgccgaagcagccgcaaaggaagctgccgctaaggccggctcagcaggttctgccgccggaagcggtgaattttcttattaccaccaccaccatcaccacttggaatctacttcattatacaagaaagcggggtccggtagtaacgaagtcacaaccttagaaaatgatgcagcctttatagaaaacgaaaatgcctacttagaaaaagaaattgcaagattgagaaaggaaaaagctgcattgagaaacagattagcccacaagaaatcttactatcaccaccatcatcatcacttggaatctacatcattatacaagaaagcgggctccggtagtgctagaaatgcctacttaagaaagaaaatagccagattgaagaaagacaatttgcaattagagagagatgaacagaacttagaaaagattatagccaatttgagagatgaaattgctagattagaaaatgaagtagcttctcatgaacaaggtagtgctggctccgctgccggctccggagaatttgccgaagctgccgccaaggaagccgcggccaaggctggttccgctggttctgctgccggatctggagaattttcctattaccatcatcatcatcatcatttggaatctacatcattatacaagaaagcgggatctggttctaacttggtcgcccaattggagaacgaagtcgcatcattggagaacgaaaacgaaaccttgaagaaaaagaacttacacaaaaaggatttgatagcttacttagaaaaagaaatcgctaatttgagaaagaaaattgaagaaggtagtgcaggttcagccgctggctccggtgaatttggttcagcggaggctgccgctaaggaggcagccgctaaagaagcagccgctaaggaggctgcagcaaaagcaggttccgcaggttctgcagcgggttccggagaatttggttctgaacaaaagttgatctctgaagaagatttggaacaaaagttgatatctgaagaagacttggaacaaaaattaatatcagaagaagatttgggtagtgcaggttcagcagctggttctggagaatttggttcagcaggttctgccgctggaagtggcgaattcggtagtgccggctccgctgctggctctggcgaatttggttctggtgctactaacttctctttgttgaagcaagcaggtgacgttgaagaaaatccaggtccaatgggttctgctggttcagctgcaggttctggtgaatttggttccgcaggtagtgccgctggttctggtgaattcggttctgctggttcagcagccggttctggtgaattttcatattaccatcaccatcaccatcacttggaatccaccagtttatacaaaaaggctggttctggttcagctagaaacgcatatttgagaaagaaaattgctagattgaagaaagataacttgcaattggaaagagatgaacaaaatttggaaaagattatcgccaacttaagagatgaaatagcaagattggaaaacgaagtagcttctcatgaacaaggttccgcaggtagtgcagctggttctggtgaatttgctgaagccgctgcaaaggaagccgctgcaaaagctggttccgctggttcagccgctggttccggtgaattcagttactatcaccatcaccatcatcacttggaatccacaagtttatataaaaaggccggttctggttcaaatttggttgctcaattagaaaacgaagtcgcatctttagaaaacgaaaacgaaacattgaaaaagaaaaatttgcataagaaagatttgatcgcttatttggaaaaggaaatcgcaaacttgagaaagaaaatagaagaaggttccgctggttctgctgctggttccggtgaatttggttcagctgaagctgcagccaaggaagctgcagccaaagaagccgctgctaaagaagctgcagccaaagcaggttctgccggttctgccgcaggttccggtgaattcggttcttcagctactagagaattggatgaattgatggcatccttaagtgacttcaagatacaaggtggttccgctggttctgcagccggctctggcgaattcgcagaagcagccgctaaggaagcagccgctaaagctggttctgcaggttctgctgccggttctggtgaattcgatttggctttgtctgaaaactgggcacaagaattcttggctgcaggtgacgctgttgatggttctgctggtagtgctgccggttcaggtgaatttggtagtgctgaagctgctgccaaagaagcagccgctaaagaagctgctgccaaggaagctgccgctaaagcaggttccgccggttctgccgccggctccggcgaatttggttcagattataaggatgacgatgacaaggattacaaagacgatgatgacaaggattataaagatgacgatgacaaaggttccgctggtagtgccgccggctctggagaattcggttctgccggttcagctgccggctccggagaatttggttccgctggtagtgcagccggttcaggtgaattcggttctggtgctactaacttctctttgttgaagcaagcaggtgacgttgaagaaaatccaggtccaatgagtgctaaggcaatttctgaacaaactggtaaagaattgttgtacaagtttatttgtactacatcagccatccaaaatagattcaaatacgctagagttaccccagatactgactgggctagattgttacaagatcatccatggttgttatctcaaaacttggttgtcaaacctgaccaattaattaagagaagaggtaaattgggtttagtaggtgttaatttgacattggatggtgtaaagtcttggttgaaaccaagattaggtcaagaagccacagttggtaaagctaccggtttcttgaaaaatttcttgatcgaaccatttgtccctcattcacaagccgaagaattctatgtatgtatctacgctactagagagggtgactatgttttatttcatcacgaaggtggtgtcgacgtaggtgacgttgacgccaaggctcaaaagttgttggttggtgtcgatgaaaagttgaacccagaagacattaaaaagcatttgttggttcacgcacctgaagataaaaaggaaatattggcctcctttataagtggtttgtttaatttctacgaagatttgtacttcacctacttggaaattaacccattagtagttactaaggatggtgtatatgttttggacttagctgcaaaagttgatgcaacagccgactacatttgtaaggtcaaatggggtgacatcgaatttccacctccattcggtagagaagcttatccagaagaagcctacattgctgatttggacgctaagtctggtgcatcattgaagttgacattgttgaaccctaaaggtagaatttggaccatggttgctggtggtggtgctagtgtcgtatattctgatactatatgcgacttgggtggtgttaacgaattggcaaactacggtgaatactcaggtgccccatccgaacaacaaacatacgattacgctaagaccatcttgtccttaatgactagagaaaagcatcctgatggtaaaatcttgatcatcggtggtagtatcgcaaattttactaacgttgccgctacattcaagggtatcgtcagagctataagagattaccaaggtccattgaaggaacacgaagtaacaatattcgttagaagaggtggtcctaactaccaagaaggtttgagagtcatgggtgaagtaggtaaaaccactggtataccaatccatgtctttggtacagaaacccacatgactgcaatagttggtatggccttaggtcatagaccaatccctaatcaacctccaaccgcagcccacactgcaaatttcttgttaaacgcctctggttcaacttccacaccagctccttctagaacagcaagtttctctgaatcaagagctgatgaagtcgctccagctaagaaagcaaaaccagccatgcctcaagactccgttccaagtcctagatctttgcagggtaaatctactactttgttttctagacatactaaggctatagtatggggtatgcaaacaagagcagttcaaggcatgttggatttcgactatgtttgtagtagagatgaaccatctgttgctgcaatggtctatccttttactggtgaccataagcaaaaattctactggggtcacaaggaaatattgatcccagtttttaagaacatggccgatgctatgagaaaacatcctgaagtcgacgtattgattaacttcgcctcattaagatccgcttacgattctacaatggaaaccatgaactacgctcaaataagaaccatcgctatcattgcagaaggtattccagaagccttgactagaaagttgattaagaaagctgatcaaaaaggtgtcacaataatcggtccagctaccgtaggtggtattaagcctggttgtttcaagatcggtaacactggtggtatgttggataacatattggcatctaagttgtatagaccaggttcagtcgcttacgtatccagaagtggtggtatgtccaacgaattgaacaacatcatcagtagaactacagatggtgtatacgaaggtgttgctattggtggtgacagatacccaggttctacttttatggatcatgtattgagatatcaagacacacctggtgttaaaatgattgttgtcttgggtgaaataggtggtactgaagaatacaagatatgcagaggtatcaaagaaggtagattgacaaagccaatcgtttgttggtgcattggtacttgtgcaacaatgttttcttcagaagttcaattcggtcatgcaggtgcctgcgctaatcaagcttcagaaacagcagttgccaagaaccaagcattaaaagaagccggtgtttttgtccctagatctttcgatgaattaggtgaaatcattcaatcagtctatgaagacttggtagctaatggtgtaattgttccagcacaagaagttcctccacctactgtccctatggattactcttgggcaagagaattgggtttaattagaaagccagctagttttatgacctctatatgtgatgaaagaggtcaagaattgatctatgctggtatgcctattactgaagtattcaaagaagaaatgggtatcggtggtgttttaggtttgttgtggttccaaaagagattgccaaagtactcttgtcaattcattgaaatgtgcttaatggttacagctgatcatggtcctgctgtctcaggtgcacacaataccataatctgcgctagagctggtaaagatttggtttcttctttgacctcaggtttgttaactattggtgacagatttggtggtgcattagacgccgctgcaaagatgttttcaaaagctttcgattccggtataatcccaatggaattcgttaataagatgaaaaaggagggtaaattgataatgggtatcggtcatcgtgttaagtctatcaataaccctgatatgagagtacaaatcttgaaggactatgttagacaacactttccagccacacctttgttagattacgctttggaagttgaaaagattaccacttctaaaaagccaaatttgatcttgaacgttgatggtttaattggtgttgcttttgtcgacatgttgagaaactgtggttccttcactagagaagaagctgatgaatatatcgacattggtgcattgaatggtatctttgttttaggtagatctatgggtttcattggtcattacttggatcaaaagagattaaagcaaggtttgtacagacatccatgggatgacatttcttacgttttacctgaacacatgtcaatgaaattgtctggtggtggtggttctggtggtggtggttctggtggtggtggtagtgccgaagcttggtacaatttgggtaacgcatactacaagcagggtgactaccaaaaggcaattgaatattaccaaaaggccttggaattagacccaaataacgcagaagcctggtataatttgggtaatgcttattataaacagggtgactatcaaaaggctatcgaatactaccaaaaggcattggaattagaccctaataacgctgaagcatggtataatttgggtaacgcttattataagcagggtgactatcaaaaagccatcgaagactaccaaaaggctttggaattagatccaaataacttacaagccgaagcttggaagaatttgggtaacgcttactataaacagggtgactaccaaaaagcaattgaatactatcaaaaagctttagaattggaccctaataacgcatcagcctggtacaatttgggtaatgcttactataagcagggtgactatcagaaggccattgaatactatcaaaaggctttagaattggatccaaataacgctaaagcatggtacagacgtggtaacgcttattacaaacagggtgactaccagaaagccattgaagattatcaaaaggctttggaattggatcctaacaacagatctagatcagctggtggtggtggttctggtggtggtggttctggtggtggtggtgcttcttcatattaccatcaccatcaccatcacttggaatccacaagtttatacaaaaaggctggttctggttcaaatttggtcgcacaattggaaaacgaagtagcctctttagaaaatgaaaacgaaaccttgaaaaagaaaaacttacataagaaagatttgatcgcttatttggaaaaggaaatcgcaaatttgagaaagaaaattgaagaaggtagtgcaggttctgccgctggttctggtgaatttggttcagctgaagcagccgctaaggaagcagccgctaaagccggttcagctggttccgcagccggttctggtgaattcggttccagttactatcaccatcaccatcatcacttggaatccacaagtttatataagaaagcaggttctggttcagcaagaaatgcctacttgagaaagaaaatagctagattaaagaaagataacttgcaattggaaagagatgaacaaaatttggaaaagattatcgccaacttaagagatgaaatcgctagattggaaaatgaagttgcatcccatgaacaaggtagtggtgctactaacttctctttgttgaagcaagcaggtgacgttgaagaaaatccaggtccaatgaaaaactgtgtaatcgtttctgctgttagaactgcaattggttcctttaatggtagtttggcctctacatcagctattgatttgggtgctaccgtcatcaaagctgcaattgaaagagcaaagattgattctcaacatgtcgacgaagtaataatgggtaacgttttgcaagctggtttaggtcaaaatccagcaagacaagccttgttaaaatctggtttagcagaaactgtatgtggtttcacagttaataaggtctgcggttctggtttgaagtcagttgctttagccgctcaagctatacaagcaggtcaagcccaatctatcgtcgctggtggtatggaaaatatgtcattggcaccttatttgttagatgcaaaagccagatcaggttatagattaggtgacggtcaagtatacgacgttattttgagagatggtttaatgtgcgctactcatggttatcacatgggtattacagcagaaaatgttgccaaagaatacggtataaccagagaaatgcaagatgaattggcattacattcccaaagaaaggcagccgctgcaatcgaaagtggtgcttttactgcagaaattgtcccagtaaacgttgtcacaagaaagaaaactttcgttttctcccaagatgaattcccaaaagctaatagtaccgctgaagcattgggtgctttaagacctgcattcgacaaggccggtaccgtaactgccggtaatgcttctggtataaacgatggtgccgctgcattggttatcatggaagaatcagccgctttagcagccggtttgacacctttagctagaattaaatcttatgcatcaggtggtgttccacctgctttgatgggtatgggtccagtccctgctacccaaaaggcattgcaattagccggtttgcaattggctgatatcgacttaatcgaagcaaacgaagcctttgctgcacaattcttggcagttggtaaaaatttgggtttcgactccgaaaaggttaatgtcaacggtggtgccattgctttgggtcatccaataggtgcttcaggtgcaagaatcttggttacattgttgcatgccatgcaagctagagataaaaccttgggtttagctactttgtgtatcggtggtggtcaaggtatcgcaatggttatcgaaagattgaataagttgtctggtggtggtggttctggtggtggtggttctggtggtggtggtagtgcagaagcctggtacaatttgggtaacgcttactacaagcagggtgactaccaaaaggcaatcgaatactaccaaaaggccttggaattagatccaaataacgctgaagcatggtataatttgggtaatgcctattataaacagggtgactatcaaaaagctattgaatattaccaaaaggcattggaattagatcctaataacgccgaagcttggtataatttgggtaacgcctattataagcagggtgactatcaaaaggccatcgaagattaccaaaaggctttggaattggatccaaacaacttgcaagcagaagcctggaagaatttgggtaacgcttattacaaacagggtgactaccaaaaagctattgaatactatcaaaaagccttagaattggatcctaataacgcttctgcatggtacaatttgggtaatgcctactataaacagggtgactaccagaaggctattgaatactaccaaaaagcattagaattggatccaaataacgccaaggcttggtacagacgtggtaatgcctattacaagcagggtgactaccagaaagccatagaagactatcaaaaagccttggaattggatcctaacaacagatccagaagtgctggtggtggtggttctggtggtggtggttctggtggtggtggtgcttcttcatattaccatcaccatcaccatcacttggaatctacatcattatacaaaaaggctggttccggtagtaatgaagttactacattggaaaacgatgccgcttttatcgaaaacgaaaacgcatacttggaaaaggaaatcgccagattaagaaaggaaaaggcagccttgagaaatagattagcccataaaaagggttccgctggtagtgctgcaggttctggtgaatttggttcagctgaagccgctgcaaaagaagccgctgcaaaggcaggttctgccggttcagccgctggttctggtgaattcggttccagttactatcaccatcaccatcatcacttggaatctacttcattatataaaaaggccggttccggtagtcaaaaagtcgctgaattaaagaacagagtagctgttaagttgaacagaaacgaacaattgaaaaataaggtagaagaattgaaaaatagaaacgcctacttaaagaatgaattggcaacattggaaaacgaagtcgctagattggaaaatgatgtagcagaaggttctggt

SEQ ID NO: 207 - DNA, 7125 bp, Artificial Sequence
  gene cassette
atgagtgctaaggcaatttctgaacaaactggtaaagaattgttgtacaagtttatttgtactacatcagccatccaaaatagattcaaatacgctagagttaccccagatactgactgggctagattgttacaagatcatccatggttgttatctcaaaacttggttgtcaaacctgaccaattaattaagagaagaggtaaattgggtttagtaggtgttaatttgacattggatggtgtaaagtcttggttgaaaccaagattaggtcaagaagccacagttggtaaagctaccggtttcttgaaaaatttcttgatcgaaccatttgtccctcattcacaagccgaagaattctatgtatgtatctacgctactagagagggtgactatgttttatttcatcacgaaggtggtgtcgacgtaggtgacgttgacgccaaggctcaaaagttgttggttggtgtcgatgaaaagttgaacccagaagacattaaaaagcatttgttggttcacgcacctgaagataaaaaggaaatattggcctcctttataagtggtttgtttaatttctacgaagatttgtacttcacctacttggaaattaacccattagtagttactaaggatggtgtatatgttttggacttagctgcaaaagttgatgcaacagccgactacatttgtaaggtcaaatggggtgacatcgaatttccacctccattcggtagagaagcttatccagaagaagcctacattgctgatttggacgctaagtctggtgcatcattgaagttgacattgttgaaccctaaaggtagaatttggaccatggttgctggtggtggtgctagtgtcgtatattctgatactatatgcgacttgggtggtgttaacgaattggcaaactacggtgaatactcaggtgccccatccgaacaacaaacatacgattacgctaagaccatcttgtccttaatgactagagaaaagcatcctgatggtaaaatcttgatcatcggtggtagtatcgcaaattttactaacgttgccgctacattcaagggtatcgtcagagctataagagattaccaaggtccattgaaggaacacgaagtaacaatattcgttagaagaggtggtcctaactaccaagaaggtttgagagtcatgggtgaagtaggtaaaaccactggtataccaatccatgtctttggtacagaaacccacatgactgcaatagttggtatggccttaggtcatagaccaatccctaatcaacctccaaccgcagcccacactgcaaatttcttgttaaacgcctctggttcaacttccacaccagctccttctagaacagcaagtttctctgaatcaagagctgatgaagtcgctccagctaagaaagcaaaaccagccatgcctcaagactccgttccaagtcctagatctttgcagggtaaatctactactttgttttctagacatactaaggctatagtatggggtatgcaaacaagagcagttcaaggcatgttggatttcgactatgtttgtagtagagatgaaccatctgttgctgcaatggtctatccttttactggtgaccataagcaaaaattctactggggtcacaaggaaatattgatcccagtttttaagaacatggccgatgctatgagaaaacatcctgaagtcgacgtattgattaacttcgcctcattaagatccgcttacgattctacaatggaaaccatgaactacgctcaaataagaaccatcgctatcattgcagaaggtattccagaagccttgactagaaagttgattaagaaagctgatcaaaaaggtgtcacaataatcggtccagctaccgtaggtggtattaagcctggttgtttcaagatcggtaacactggtggtatgttggataacatattggcatctaagttgtatagaccaggttcagtcgcttacgtatccagaagtggtggtatgtccaacgaattgaacaacatcatcagtagaactacagatggtgtatacgaaggtgttgctattggtggtgacagatacccaggttctacttttatggatcatgtattgagatatcaagacacacctggtgttaaaatgattgttgtcttgggtgaaataggtggtactgaagaatacaagatatgcagaggtatcaaagaaggtagattgacaaagccaatcgtttgttggtgcattggtacttgtgcaacaatgttttcttcagaagttcaattcggtcatgcaggtgcctgcgctaatcaagcttcagaaacagcagttgccaagaaccaagcattaaaagaagccggtgtttttgtccctagatctttcgatgaattaggtgaaatcattcaatcagtctatgaagacttggtagctaatggtgtaattgttccagcacaagaagttcctccacctactgtccctatggattactcttgggcaagagaattgggtttaattagaaagccagctagttttatgacctctatatgtgatgaaagaggtcaagaattgatctatgctggtatgcctattactgaagtattcaaagaagaaatgggtatcggtggtgttttaggtttgttgtggttccaaaagagattgccaaagtactcttgtcaattcattgaaatgtgcttaatggttacagctgatcatggtcctgctgtctcaggtgcacacaataccataatctgcgctagagctggtaaagatttggtttcttctttgacctcaggtttgttaactattggtgacagatttggtggtgcattagacgccgctgcaaagatgttttcaaaagctttcgattccggtataatcccaatggaattcgttaataagatgaaaaaggagggtaaattgataatgggtatcggtcatcgtgttaagtctatcaataaccctgatatgagagtacaaatcttgaaggactatgttagacaacactttccagccacacctttgttagattacgctttggaagttgaaaagattaccacttctaaaaagccaaatttgatcttgaacgttgatggtttaattggtgttgcttttgtcgacatgttgagaaactgtggttccttcactagagaagaagctgatgaatatatcgacattggtgcattgaatggtatctttgttttaggtagatctatgggtttcattggtcattacttggatcaaaagagattaaagcaaggtttgtacagacatccatgggatgacatttcttacgttttacctgaacacatgtcaatgaaattgtctggtggtggtggttctggtggtggtggttctggtggtggtggtagtgccgaagcttggtacaatttgggtaacgcatactacaagcagggtgactaccaaaaggcaattgaatattaccaaaaggccttggaattagacccaaataacgcagaagcctggtataatttgggtaatgcttattataaacagggtgactatcaaaaggctatcgaatactaccaaaaggcattggaattagaccctaataacgctgaagcatggtataatttgggtaacgcttattataagcagggtgactatcaaaaagccatcgaagactaccaaaaggctttggaattagatccaaataacttacaagccgaagcttggaagaatttgggtaacgcttactataaacagggtgactaccaaaaagcaattgaatactatcaaaaagctttagaattggaccctaataacgcatcagcctggtacaatttgggtaatgcttactataagcagggtgactatcagaaggccattgaatactatcaaaaggctttagaattggatccaaataacgctaaagcatggtacagacgtggtaacgcttattacaaacagggtgactaccagaaagccattgaagattatcaaaaggctttggaattggatcctaacaacagatctagatcagctggtggtggtggttctggtggtggtggttctggtggtggtggtgcttcttcatattaccatcaccatcaccatcacttggaatccacaagtttatacaaaaaggctggttctggttcaaatttggtcgcacaattggaaaacgaagtagcctctttagaaaatgaaaacgaaaccttgaaaaagaaaaacttacataagaaagatttgatcgcttatttggaaaaggaaatcgcaaatttgagaaagaaaattgaagaaggtagtgcaggttctgccgctggttctggtgaatttggttcagctgaagcagccgctaaggaagcagccgctaaagccggttcagctggttccgcagccggttctggtgaattcggttccagttactatcaccatcaccatcatcacttggaatccacaagtttatataagaaagcaggttctggttcagcaagaaatgcctacttgagaaagaaaatagctagattaaagaaagataacttgcaattggaaagagatgaacaaaatttggaaaagattatcgccaacttaagagatgaaatcgctagattggaaaatgaagttgcatcccatgaacaaggtagtggtgctactaacttctctttgttgaagcaagcaggtgacgttgaagaaaatccaggtccaatgaaaaactgtgtaatcgtttctgctgttagaactgcaattggttcctttaatggtagtttggcctctacatcagctattgatttgggtgctaccgtcatcaaagctgcaattgaaagagcaaagattgattctcaacatgtcgacgaagtaataatgggtaacgttttgcaagctggtttaggtcaaaatccagcaagacaagccttgttaaaatctggtttagcagaaactgtatgtggtttcacagttaataaggtctgcggttctggtttgaagtcagttgctttagccgctcaagctatacaagcaggtcaagcccaatctatcgtcgctggtggtatggaaaatatgtcattggcaccttatttgttagatgcaaaagccagatcaggttatagattaggtgacggtcaagtatacgacgttattttgagagatggtttaatgtgcgctactcatggttatcacatgggtattacagcagaaaatgttgccaaagaatacggtataaccagagaaatgcaagatgaattggcattacattcccaaagaaaggcagccgctgcaatcgaaagtggtgcttttactgcagaaattgtcccagtaaacgttgtcacaagaaagaaaactttcgttttctcccaagatgaattcccaaaagctaatagtaccgctgaagcattgggtgctttaagacctgcattcgacaaggccggtaccgtaactgccggtaatgcttctggtataaacgatggtgccgctgcattggttatcatggaagaatcagccgctttagcagccggtttgacacctttagctagaattaaatcttatgcatcaggtggtgttccacctgctttgatgggtatgggtccagtccctgctacccaaaaggcattgcaattagccggtttgcaattggctgatatcgacttaatcgaagcaaacgaagcctttgctgcacaattcttggcagttggtaaaaatttgggtttcgactccgaaaaggttaatgtcaacggtggtgccattgctttgggtcatccaataggtgcttcaggtgcaagaatcttggttacattgttgcatgccatgcaagctagagataaaaccttgggtttagctactttgtgtatcggtggtggtcaaggtatcgcaatggttatcgaaagattgaataagttgtctggtggtggtggttctggtggtggtggttctggtggtggtggtagtgcagaagcctggtacaatttgggtaacgcttactacaagcagggtgactaccaaaaggcaatcgaatactaccaaaaggccttggaattagatccaaataacgctgaagcatggtataatttgggtaatgcctattataaacagggtgactatcaaaaagctattgaatattaccaaaaggcattggaattagatcctaataacgccgaagcttggtataatttgggtaacgcctattataagcagggtgactatcaaaaggccatcgaagattaccaaaaggctttggaattggatccaaacaacttgcaagcagaagcctggaagaatttgggtaacgcttattacaaacagggtgactaccaaaaagctattgaatactatcaaaaagccttagaattggatcctaataacgcttctgcatggtacaatttgggtaatgcctactataaacagggtgactaccagaaggctattgaatactaccaaaaagcattagaattggatccaaataacgccaaggcttggtacagacgtggtaatgcctattacaagcagggtgactaccagaaagccatagaagactatcaaaaagccttggaattggatcctaacaacagatccagaagtgctggtggtggtggttctggtggtggtggttctggtggtggtggtgcttcttcatattaccatcaccatcaccatcacttggaatctacatcattatacaaaaaggctggttccggtagtaatgaagttactacattggaaaacgatgccgcttttatcgaaaacgaaaacgcatacttggaaaaggaaatcgccagattaagaaaggaaaaggcagccttgagaaatagattagcccataaaaagggttccgctggtagtgctgcaggttctggtgaatttggttcagctgaagccgctgcaaaagaagccgctgcaaaggcaggttctgccggttcagccgctggttctggtgaattcggttccagttactatcaccatcaccatcatcacttggaatctacttcattatataaaaaggccggttccggtagtcaaaaagtcgctgaattaaagaacagagtagctgttaagttgaacagaaacgaacaattgaaaaataaggtagaagaattgaaaaatagaaacgcctacttaaagaatgaattggcaacattggaaaacgaagtcgctagattggaaaatgatgtagcagaaggttctggt

SEQ ID NO: 208 - protein, 7 aa, Artificial Sequence
  peptide binding motif
GVKESLV

SEQ ID NO: 209 - protein, 723 aa, Artificial Sequence
  chimeric enzymes
MGKNYKSLDSVVASDFIALGITSEVAETLHGRLAEIVCNYGAATPQTWINIANHILSPDLPFSLHQMLFYGCYKDFGPAPPAWIPDPEKVKSTNLGALLEKRGKEFLGVKYKDPISSFSHFQEFSVRNPEVYWRTVLMDEMKISFSKDPECILRRDDINNPGGSEWLPGGYLNSAKNCLNVNSNKKLNDTMIVWRDEGNDDLPLNKLTLDQLRKRVWLVGYALEEMGLEKGCAIAIDMPMHVDAVVIYLAIVLAGYVVVSIADSFSAPEISTRLRLSKAKAIFTQDHIIRGKKRIPLYSRVVEAKSPMAIVIPCSGSNIGAELRDGDISWDYFLERAKEFKNCEFTAREQPVDAYTNILFSSGTTGEPKAIPWTQATPLKAAADGWSHLDIRKGDVIVWPTNLGWMMGPWLVYASLLNGASIALYNGSPLVSGFAKFVQDAKVTMLGVVPSIVRSWKSTNCVSGYDWSTIRCFSSSGEASNVDEYLWLMGRANYKPVIEMCGGTEIGGAFSAGSFLQAQSLSSFSSQCMGCTLYILDKNGYPMPKNKPGIGELALGPVMFGASKTLLNGNHHDVYFKGMPTLNGEVLRRHGDIFELTSNGYYHAHGRADDTMNIGGIKISSIEIERVCNEVDDRVFETTAIGVPPLGGGPEQLVIFFVLKDSNDTTIDLNQLRLSFNLGLQKKLNPLFKVTRVVPLSSLPRTATNKIMRRVLRQQFSHFEGSG

SEQ ID NO: 210 - protein, 127 aa, Artificial Sequence
  peptide binding motif
GSHMGSQFWVTSQKTEASERCGLQGSYILRVEAEKLTLLTLGAQSQILEPLLFWPYTLLRRYGRDKVMFSFEAGRRCPSGPGTFTFQTSQGNDIFQAVEAAIQQQKAQGKVGQAQDILRLEHHHHHH

SEQ ID NO: 211 - protein, 2741 aa, Artificial Sequence
  chimeric enzymes
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLSDGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVSVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLKKLSGGGGSGGGGSGGGGSAEAWYNLGNAYYKQGDYQKAIEYYQKALELDPNNAEAWYNLGNAYYKQGDYQKAIEYYQKALELDPNNAEAWYNLGNAYYKQGDYQKAIEDYQKALELDPNNLQAEAWKNLGNAYYKQGDYQKAIEYYQKALELDPNNASAWYNLGNAYYKQGDYQKAIEYYQKALELDPNNAKAWYRRGNAYYKQGDYQKAIEDYQKALELDPNNRSRSAGGGGSGGGGSGGGGASGSHMRLGAQSIQPTANLDRTDDLVYLNVMELVRAVLELKNELAQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAEGSAGSAAGSGEFGSAEAAAKEAAAKAGSAGSAAGSGEFGSGAMATPGSENVLPREPLIATAVKFLQNSRVRQSPLATRRAFLKKKGLTDEEIDMAFQQSGTAADEPSSLW

SEQ ID NO: 212 - DNA, 57 bp, Artificial Sequence
  codon-optimized
gctactaacttctctttgttgaagcaagcaggtgacgttgaagaaaatccaggtcca

What is claimed is:

1. A host cell capable of producing one or more cannabinoids selected from the group consisting of cannabigerolic acid, cannabidiolic acid, and cannabichromenic acid, said host cell comprising:

(a) a first exogenous nucleic acid encoding a first polypeptide having CBGA synthase activity and comprising a first heterologous interaction domain, (b) a second exogenous nucleic acid encoding a second polypeptide having olivetolic acid cyclase activity and comprising a second heterologous interaction domain, (c) a third exogenous nucleic acid encoding a third polypeptide having olivetol synthase activity and comprising a third heterologous interaction domain, (d) a fourth exogenous nucleic acid encoding a fourth polypeptide having trans-2-enoyl-CoA reductase activity and comprising a fourth heterologous interaction domain, (e) a fifth exogenous nucleic acid encoding a fifth polypeptide having enoyl-CoA hydratase activity and comprising a fifth heterologous interaction domain, (f) a sixth exogenous nucleic acid encoding a sixth polypeptide having 3-hydroxybutyryl-CoA dehydrogenase activity and comprising a sixth heterologous interaction domain, (g) a seventh exogenous nucleic acid encoding a seventh polypeptide having beta-ketothiolase activity and comprising a seventh heterologous interaction domain, (h) an eighth exogenous nucleic acid encoding an eighth polypeptide having acetyl-CoA acetyltransferase activity and comprising an eighth heterologous interaction domain, (i) a ninth exogenous nucleic acid encoding a ninth polypeptide having ATP citrate lyase activity and comprising a ninth heterologous interaction domain, (j) a tenth exogenous nucleic acid encoding a tenth polypeptide having geranyl pyrophosphate synthase activity and comprising a tenth heterologous interaction domain, (k) an eleventh exogenous nucleic acid encoding an eleventh polypeptide having isopentyl-diphosphate isomerase activity and comprising an eleventh heterologous interaction domain, (l) a twelfth exogenous nucleic acid encoding a twelfth polypeptide having diphospho-mevalonate decarboxylase activity and comprising a twelfth heterologous interaction domain, (m) a thirteenth exogenous nucleic acid encoding a thirteenth polypeptide having phosphomevalonate kinase activity and comprising a thirteenth heterologous interaction domain, (n) a fourteenth exogenous nucleic acid encoding a fourteenth polypeptide having mevalonate kinase activity and comprising a fourteenth heterologous interaction domain, (o) a fifteenth exogenous nucleic acid encoding a fifteenth polypeptide having HMG-CoA reductase activity and comprising a fifteenth heterologous interaction domain, (p) a sixteenth exogenous nucleic acid encoding a sixteenth polypeptide having HMG-CoA synthase activity and comprising a sixteenth heterologous interaction domain, and (q) a seventeenth exogenous nucleic acid encoding a polypeptide scaffold comprising a peptide ligand for each of said first to sixteenth heterologous interaction domains, wherein each of said first to sixteenth heterologous interaction domains is different, wherein each peptide ligand for each of said first to sixteenth heterologous interaction domains is different, wherein said polypeptide scaffold comprises, in an order extending in a first direction away from said peptide ligand for said first heterologous interaction domain, (1) said peptide ligand for said second heterologous interaction domain, (2) said peptide ligand for said third heterologous interaction domain, (3) said peptide ligand for said fourth heterologous interaction domain, (4) said peptide ligand for said fifth heterologous interaction domain, (5) said peptide ligand for said sixth heterologous interaction domain, (6) said peptide ligand for said seventh heterologous interaction domain, (7) said peptide ligand for said fourth heterologous interaction domain, (8) said peptide ligand for said fifth heterologous interaction domain, (9) said peptide ligand for said sixth heterologous interaction domain, (10) said peptide ligand for said eighth heterologous interaction domain, and (11) said peptide ligand for said ninth heterologous interaction domain, and wherein said polypeptide scaffold comprises, in an order extending in the other direction away from said peptide ligand for said first heterologous interaction domain, (1) said peptide ligand for said tenth heterologous interaction domain, (2) said peptide ligand for said eleventh heterologous interaction domain, (3) said peptide ligand for said twelfth heterologous interaction domain, (4) said peptide ligand for said thirteenth heterologous interaction domain, (5) said peptide ligand for said fourteenth heterologous interaction domain, (6) said peptide ligand for said fifteenth heterologous interaction domain, (7) said peptide ligand for said sixteenth heterologous interaction domain, (8) said peptide ligand for said eighth heterologous interaction domain, and (9) said peptide ligand for said ninth heterologous interaction domain.

2. The host cell of claim 1, wherein each of said polypeptides is of the formula: enzyme-$linker_1$-spacer-$linker_2$-$motif_1$-$linker_3$-$motif_2$, wherein $linker_1$, $linker_2$, and $linker_3$ are the same or different, wherein $motif_1$ and $motif_2$ are the same or different, and wherein $motif_1$ and $motif_2$ form said heterologous interaction domain.

3. The host cell of claim 2, wherein said scaffold polypeptide comprises a linker between each adjacent peptide ligand.

4. The host cell of claim 3, wherein said scaffold polypeptide is tagged with a MYC tag, FLAG tag, or HA tag.

5. The host cell of claim 2, wherein said linker is a flexible GS-rich sequence flanking a rigid α-helical moiety.

6. The host cell of claim 2, wherein said spacer is the cTPR6 spacer.

7. The host cell of claim 1, wherein a constitutive promoter is operably linked to one or more of said exogenous nucleic acids encoding said polypeptides or to said seventeenth exogenous nucleic acid encoding said polypeptide scaffold.

8. The host cell of claim 1, wherein each said exogenous nucleic acid comprises an inducible promoter operably linked to the sequence encoding said polypeptide or said polypeptide scaffold.

9. The host cell of claim 8, wherein said promoter is the GAL1-10 promoter.

10. The host cell of claim 1, wherein a first constitutive promoter is operably linked to one or more of said exogenous nucleic acids encoding said polypeptides and a second constitutive promoter is operably linked to said seventeenth exogenous nucleic acid encoding said polypeptide scaffold.

11. The host cell of claim 10, wherein said constitutive promoter used to express said polypeptide scaffold has weaker constitutive activity level than said constitutive promoter used to express said polypeptides.

12. The host cell of claim 1, further comprising (r) an eighteenth exogenous nucleic acid encoding an acetyl-CoA carboxylase and comprising an eighteenth heterologous interaction domain, and (s) a nineteenth exogenous nucleic acid encoding a polypeptide scaffold comprising a peptide ligand for each of said ninth and eighteenth heterologous interaction domains.

13. The host cell of claim 1, wherein said host cell further comprises an exogenous nucleic acid encoding a cannabidiolic acid synthase and a cannabichromenic acid synthase.

14. The host cell of claim 1, wherein said host cell further comprises an exogenous cannabidiolic acid synthase.

15. The host cell of claim 1, wherein said host cell further comprises an exogenous cannabichromenic acid synthase.

16. The host cell of claim 1, wherein said host cell is a bacterial or a yeast host cell.

17. The host cell of claim 16, wherein said bacterial cell is selected from the group consisting of *Escherichia coli*, *Bacillus*, *Brevibacterium*, *Streptomyces*, and *Pseudomonas* cells.

18. The host cell of claim 16, wherein said yeast cell is selected from the group consisting of *Pichia pastoris*, *Saccharomyces cerevisiae*, *Yarrowia lipolytica*, *Kluyveromyces marxianus*, and *Komagataella phaffii* cells.

19. The host cell of claim 1, wherein said host cell is an algae or a plant cell.

20. The host cell of claim 19, wherein said algae is *Dunaliella* sp., *Chlorella variabilis*, *Euglena mutabilis*, or *Chlamydomonas reinhardtii* cells.

21. The host cell of claim 19, wherein said plant cell is a *Cannabis* or tobacco cell.

22. A method of producing one or more cannabinoids selected from the group consisting of cannabigerolic acid, cannabidiolic acid, and cannabichromenic acid, said method comprising culturing a host cell under conditions wherein said host cell produces said one or more cannabinoids, wherein said host cell comprises:
(a) a first exogenous nucleic acid encoding a first polypeptide having CBGA synthase activity and comprising a first heterologous interaction domain,
(b) a second exogenous nucleic acid encoding a second polypeptide having olivetolic acid cyclase activity and comprising a second heterologous interaction domain,
(c) a third exogenous nucleic acid encoding a third polypeptide having olivetol synthase activity and comprising a third heterologous interaction domain,
(d) a fourth exogenous nucleic acid encoding a fourth polypeptide having trans-2-enoyl-CoA reductase activity and comprising a fourth heterologous interaction domain,
(e) a fifth exogenous nucleic acid encoding a fifth polypeptide having enoyl-CoA hydratase activity and comprising a fifth heterologous interaction domain,
(f) a sixth exogenous nucleic acid encoding a sixth polypeptide having 3-hydroxybutyryl-CoA dehydrogenase activity and comprising a sixth heterologous interaction domain,
(g) a seventh exogenous nucleic acid encoding a seventh polypeptide having beta-ketothiolase activity and comprising a seventh heterologous interaction domain,
(h) an eighth exogenous nucleic acid encoding an eighth polypeptide having acetyl-CoA acetyltransferase activity and comprising an eighth heterologous interaction domain,
(i) a ninth exogenous nucleic acid encoding a ninth polypeptide having ATP citrate lyase activity and comprising a ninth heterologous interaction domain,
(j) a tenth exogenous nucleic acid encoding a tenth polypeptide having geranyl pyrophosphate synthase activity and comprising a tenth heterologous interaction domain,
(k) an eleventh exogenous nucleic acid encoding an eleventh polypeptide having isopentyl-diphosphate isomerase activity and comprising an eleventh heterologous interaction domain,
(l) a twelfth exogenous nucleic acid encoding a twelfth polypeptide having diphospho-mevalonate decarboxylase activity and comprising a twelfth heterologous interaction domain,
(m) a thirteenth exogenous nucleic acid encoding a thirteenth polypeptide having phosphomevalonate kinase activity and comprising a thirteenth heterologous interaction domain,
(n) a fourteenth exogenous nucleic acid encoding a fourteenth polypeptide having mevalonate kinase activity and comprising a fourteenth heterologous interaction domain,
(o) a fifteenth exogenous nucleic acid encoding a fifteenth polypeptide having HMG-CoA reductase activity and comprising a fifteenth heterologous interaction domain,
(p) a sixteenth exogenous nucleic acid encoding a sixteenth polypeptide having HMG-CoA synthase activity and comprising a sixteenth heterologous interaction domain, and
(q) a seventeenth exogenous nucleic acid encoding a polypeptide scaffold comprising a peptide ligand for each of said first to sixteenth heterologous interaction domains,
wherein each of said first to sixteenth heterologous interaction domains is different,
wherein each peptide ligand for each of said first to sixteenth heterologous interaction domains is different,
wherein said polypeptide scaffold comprises, in an order extending in a first direction away from said peptide ligand for said first heterologous interaction domain, (1) said peptide ligand for said second heterologous interaction domain, (2) said peptide ligand for said third heterologous interaction domain, (3) said peptide ligand for said fourth heterologous interaction domain, (4) said peptide ligand for said fifth heterologous interaction domain, (5) said peptide ligand for said sixth heterologous interaction domain, (6) said peptide ligand for said seventh heterologous interaction domain, (7) said peptide ligand for said fourth heterologous interaction domain, (8) said peptide ligand for said fifth heterologous interaction domain, (9) said peptide ligand for said sixth heterologous interaction domain, (10) said peptide ligand for said eighth heterologous interaction domain, and (11) said peptide ligand for said ninth heterologous interaction domain, and
wherein said polypeptide scaffold comprises, in an order extending in the other direction away from said peptide ligand for said first heterologous interaction domain, (1) said peptide ligand for said tenth heterologous interaction domain, (2) said peptide ligand for said eleventh heterologous interaction domain, (3) said peptide ligand for said twelfth heterologous interaction domain, (4) said peptide ligand for said thirteenth heterologous interaction domain, (5) said peptide ligand for said fourteenth heterologous interaction domain, (6) said peptide ligand for said fifteenth heterologous interaction domain, (7) said peptide ligand for said sixteenth heterologous interaction domain, (8) said peptide ligand for said eighth heterologous interaction domain, and (9) said peptide ligand for said ninth heterologous interaction domain.

23. The method of claim 22, wherein said host is cultured in a culture medium supplemented with buffered citrate, glucose, hexanoic acid, and/or other carbon source.

24. The method of claim 22, wherein said host is cultured in a culture medium supplemented with malonyl-CoA.

25. The method of claim 22, wherein said host is cultured in a culture medium supplemented with buffered citrate.

26. The method of claim 22, said method further comprising extracting said one or more cannabinoids from said host cell.

* * * * *